United States Patent
Nonnenmacher et al.

(10) Patent No.: US 12,296,025 B2
(45) Date of Patent: May 13, 2025

(54) AAV CAPSID VARIANTS AND USES THEREOF

(71) Applicant: VOYAGER THERAPEUTICS, INC., Lexington, MA (US)

(72) Inventors: Mathieu Emmanuel Nonnenmacher, Boston, MA (US); Tyler Christopher Moyer, Boston, MA (US); Jiangyu Li, Watertown, MA (US); Dan Richard Laks, Cambridge, MA (US)

(73) Assignee: VOYAGER THERAPEUTICS, INC., Lexington, MA (US)

( * ) Notice: Subject to any disclaimer, the term of this patent is extended or adjusted under 35 U.S.C. 154(b) by 0 days.

(21) Appl. No.: 18/757,141

(22) Filed: Jun. 27, 2024

(65) Prior Publication Data

US 2024/0374756 A1    Nov. 14, 2024

Related U.S. Application Data

(63) Continuation of application No. 18/703,166, filed as application No. PCT/US2022/079060 on Nov. 1, 2022.

(60) Provisional application No. 63/339,711, filed on May 9, 2022, provisional application No. 63/274,806, filed on Nov. 2, 2021.

(51) Int. Cl.
| | |
|---|---|
| A61K 48/00 | (2006.01) |
| A61K 9/00 | (2006.01) |
| A61K 47/64 | (2017.01) |
| C07K 7/06 | (2006.01) |
| C07K 14/005 | (2006.01) |
| C12N 15/86 | (2006.01) |

(52) U.S. Cl.
CPC ........ *A61K 48/0041* (2013.01); *A61K 9/0019* (2013.01); *A61K 47/64* (2017.08); *A61K 48/0058* (2013.01); *A61K 48/0075* (2013.01); *C07K 7/06* (2013.01); *C07K 14/005* (2013.01); *C12N 15/86* (2013.01); *C12N 2750/14122* (2013.01); *C12N 2750/14141* (2013.01); *C12N 2750/14143* (2013.01); *C12N 2750/14151* (2013.01); *C12N 2830/50* (2013.01)

(58) Field of Classification Search
None
See application file for complete search history.

(56) References Cited

U.S. PATENT DOCUMENTS

| | | |
|---|---|---|
| 9,409,953 B2 | 8/2016 | Asokan et al. |
| 9,585,971 B2 | 3/2017 | Deverman et al. |
| 9,644,205 B2 | 5/2017 | Brunicardi et al. |
| 9,938,541 B2 | 4/2018 | Nishie et al. |
| 10,081,659 B2 | 9/2018 | Chiorini et al. |
| 10,265,417 B2 | 4/2019 | Wilson et al. |
| 10,485,993 B2 | 11/2019 | Goer et al. |
| 10,695,441 B2 | 6/2020 | Wilson et al. |
| 10,973,928 B2 | 4/2021 | Wilson et al. |
| 11,149,256 B2 | 10/2021 | Gradinaru et al. |
| 11,459,558 B2 | 10/2022 | Nakai et al. |
| 11,572,637 B2 | 2/2023 | Nakai et al. |
| 11,859,200 B2 | 1/2024 | Nonnenmacher et al. |
| 11,981,967 B2 | 5/2024 | McGovern et al. |
| 2004/0132042 A1 | 7/2004 | Frankard et al. |
| 2005/0148076 A1 | 7/2005 | Allen |
| 2010/0186103 A1 | 7/2010 | Gao et al. |
| 2013/0035472 A1 | 2/2013 | Horlick et al. |
| 2013/0296409 A1 | 11/2013 | Miller et al. |
| 2016/0333375 A1 | 11/2016 | Chen |
| 2017/0166926 A1 | 6/2017 | Deverman et al. |
| 2017/0204144 A1 | 7/2017 | Deverman et al. |
| 2018/0230186 A1 | 8/2018 | Deverman et al. |
| 2018/0265571 A1 | 9/2018 | Esteves et al. |
| 2020/0165576 A1 | 5/2020 | Gradinaru et al. |
| 2020/0237799 A1 | 7/2020 | Sah et al. |
| 2020/0239912 A1 | 7/2020 | Sah et al. |
| 2020/0316221 A1 | 10/2020 | Gao et al. |
| 2021/0163985 A1 | 6/2021 | Sah et al. |
| 2021/0207167 A1 | 7/2021 | Hou et al. |
| 2021/0214749 A1 | 7/2021 | Hou et al. |
| 2021/0230632 A1 | 7/2021 | Sah et al. |
| 2021/0277418 A1 | 9/2021 | Sah et al. |
| 2021/0371470 A1 | 12/2021 | Murlidharan et al. |
| 2021/0380969 A1 | 12/2021 | Nonnenmacher et al. |
| 2021/0393713 A1 | 12/2021 | Hordeaux et al. |
| 2022/0042044 A1 | 2/2022 | Nonnenmacher et al. |
| 2022/0064675 A1 | 3/2022 | McCoy et al. |
| 2022/0186256 A1 | 6/2022 | Danos et al. |
| 2023/0119163 A1 | 4/2023 | Nakai et al. |
| 2023/0131352 A1 | 4/2023 | Nonnenmacher et al. |
| 2023/0203102 A1 | 6/2023 | Nonnenmacher et al. |
| 2024/0200097 A1 | 6/2024 | Nonnenmacher et al. |

(Continued)

FOREIGN PATENT DOCUMENTS

| | | |
|---|---|---|
| CN | 106032540 A | 10/2016 |
| CN | 106884014 A | 6/2017 |

(Continued)

OTHER PUBLICATIONS

Kotterman et al. "4D-C102, a novel muscle-tropic AAV variant demonstrates superior gene delivery in cardiac and skeletal muscle tissues versus wild-type AAV in human cells and non-human primates."

(Continued)

*Primary Examiner* — Robert M Kelly

(74) *Attorney, Agent, or Firm* — K&L Gates LLP

(57) ABSTRACT

The disclosure relates to compositions and methods for the preparation, use, and/or formulation of adeno-associated virus capsid protein variants.

30 Claims, No Drawings
Specification includes a Sequence Listing.

(56) References Cited

U.S. PATENT DOCUMENTS

| | | |
|---|---|---|
| 2024/0391988 A1 | 11/2024 | Liu et al. |
| 2025/0001012 A1 | 1/2025 | Nonnenmacher et al. |
| 2025/0011372 A1 | 1/2025 | Nonnenmacher et al. |
| 2025/0034559 A1 | 1/2025 | Nonnenmacher et al. |

FOREIGN PATENT DOCUMENTS

| | | |
|---|---|---|
| CN | 108330147 A | 7/2018 |
| WO | 2004096993 A2 | 11/2004 |
| WO | 2005033321 A2 | 4/2005 |
| WO | 2010138263 A2 | 12/2010 |
| WO | 2011133890 A1 | 10/2011 |
| WO | 2012109570 A1 | 8/2012 |
| WO | 2012145601 A2 | 10/2012 |
| WO | 2015038958 A1 | 3/2015 |
| WO | 2015164757 A1 | 10/2015 |
| WO | 2016065001 A1 | 4/2016 |
| WO | 2016073693 A2 | 5/2016 |
| WO | 2016081811 A1 | 5/2016 |
| WO | 2016126857 A1 | 8/2016 |
| WO | 2016164642 A1 | 10/2016 |
| WO | 2017058892 A2 | 4/2017 |
| WO | 2017100671 A1 | 6/2017 |
| WO | 2017143100 A1 | 8/2017 |
| WO | 2018022905 A2 | 2/2018 |
| WO | 2018035213 A1 | 2/2018 |
| WO | 2018119330 A2 | 6/2018 |
| WO | 2018226785 A1 | 12/2018 |
| WO | 2019006043 A1 | 1/2019 |
| WO | 2019006418 A2 | 1/2019 |
| WO | 2019028306 A2 | 2/2019 |
| WO | 2019060454 A2 | 3/2019 |
| WO | 2019068854 A1 | 4/2019 |
| WO | 2019169132 A1 | 9/2019 |
| WO | 2019213668 A1 | 11/2019 |
| WO | 2019222329 A1 | 11/2019 |
| WO | 2019222441 A1 | 11/2019 |
| WO | 2019222444 A2 | 11/2019 |
| WO | 2020014471 A1 | 1/2020 |
| WO | 2020028751 A2 | 2/2020 |
| WO | 2020068990 A1 | 4/2020 |
| WO | 2020072683 A1 | 4/2020 |
| WO | 2020077165 A1 | 4/2020 |
| WO | 2020154324 A1 | 7/2020 |
| WO | 2020160337 A1 | 8/2020 |
| WO | 2020160508 A1 | 8/2020 |
| WO | 2020191300 A1 | 9/2020 |
| WO | 2020193799 A1 | 10/2020 |
| WO | 2020205889 A1 | 10/2020 |
| WO | 2020206189 A1 | 10/2020 |
| WO | 2020210655 A1 | 10/2020 |
| WO | 2020219933 A1 | 10/2020 |
| WO | 2020219988 A2 | 10/2020 |
| WO | 2020223280 A1 | 11/2020 |
| WO | 2021025995 A1 | 2/2021 |
| WO | 2021073568 A1 | 4/2021 |
| WO | 2021113512 A1 | 6/2021 |
| WO | 2021202651 A1 | 10/2021 |
| WO | 2021216456 A2 | 10/2021 |
| WO | 2021222831 A2 | 11/2021 |
| WO | 2021230987 A1 | 11/2021 |
| WO | 2021242909 A1 | 12/2021 |
| WO | 2022040527 A2 | 2/2022 |
| WO | 2022076750 A2 | 4/2022 |
| WO | 2022187548 A1 | 9/2022 |
| WO | 2022/221400 A2 | 10/2022 |
| WO | 2022/221404 A2 | 10/2022 |
| WO | 2022/221420 A2 | 10/2022 |
| WO | 2022/221421 A2 | 10/2022 |
| WO | 2022/235702 A2 | 11/2022 |
| WO | 2023/004416 A1 | 1/2023 |
| WO | 2023/044306 A1 | 3/2023 |
| WO | 2023/049710 A1 | 3/2023 |
| WO | 2023044483 A2 | 3/2023 |
| WO | 2023/091934 A1 | 5/2023 |
| WO | 2023081648 A1 | 5/2023 |
| WO | 2023091948 A1 | 5/2023 |
| WO | 2023091949 A2 | 5/2023 |
| WO | 2023092002 A2 | 5/2023 |
| WO | 2023092004 A1 | 5/2023 |
| WO | 2023154693 A1 | 8/2023 |
| WO | 2023/168333 A1 | 9/2023 |
| WO | 2023/183582 A2 | 9/2023 |
| WO | 2023/183583 A2 | 9/2023 |
| WO | 2023201207 A1 | 10/2023 |
| WO | 2023/215546 A2 | 11/2023 |
| WO | 2023/225508 A2 | 11/2023 |
| WO | 2023220695 A2 | 11/2023 |
| WO | 2023/244919 A1 | 12/2023 |
| WO | 2023/244920 A2 | 12/2023 |
| WO | 2023235791 A1 | 12/2023 |
| WO | 2023250388 A1 | 12/2023 |
| WO | 2024006741 A1 | 1/2024 |
| WO | 2024011112 A1 | 1/2024 |
| WO | 2024030976 A2 | 2/2024 |
| WO | 2024059739 A1 | 3/2024 |
| WO | 2024/086628 A2 | 4/2024 |
| WO | 2024086747 A1 | 4/2024 |
| WO | 2024/092164 A1 | 5/2024 |
| WO | 2024191778 A1 | 9/2024 |
| WO | 2024226761 A2 | 10/2024 |
| WO | 2024226790 A1 | 10/2024 |
| WO | 2024228943 A1 | 11/2024 |
| WO | 2024229125 A2 | 11/2024 |
| WO | 2024229161 A1 | 11/2024 |
| WO | 2024229163 A1 | 11/2024 |
| WO | 2024229164 A2 | 11/2024 |
| WO | 2024229167 A1 | 11/2024 |
| WO | 2024229173 A2 | 11/2024 |
| WO | 2024229389 A1 | 11/2024 |
| WO | 2024229425 A1 | 11/2024 |
| WO | 2024238579 A2 | 11/2024 |
| WO | 2024238684 A1 | 11/2024 |

OTHER PUBLICATIONS

Kotterman et al. "Engineering adeno-associated viruses for clinical gene therapy," Nature Reviews Genetics (2014) vol. 15, pp. 445-451.

Kotterman et al., "Directed evolution of AAV targeting lung epithelia using aerosol delivery identifies 4D-A101, a variant demonstrating robust gene delivery in non-human primates" Abstract 1336, 31 pages.

Kumar et al. "Evolution and Investigation of Engineered AAV Capsids Exhibiting Enhanced Transduction of the Central Nervous System with or without Murine Strain Specificity," Molecular Therapy (2020) vol. 28, No. 4S1, pp. 11-12, Abstract 22.

Kumar et al. "Multiplexed Cre-dependent selection yields systemic AAVs for targeting distinct brain cell types," Nature Methods (2020) vol. 17, No. 5, pp. 541-550.

Li et al. "A Novel AAV Capsid with a Potential of Crossing NHP Blood-Brain Barrier," Molecular Therapy (2020) vol. 28, No. 4S1, pp. 253, Abstract 572.

Liu, W. et al. "AAV Gene Delivery of the Anti-Tau Antibody PHF1 Reduces Brain Tau Pathology in P301L Mice," Molecular Therapy vol. 23, Supplement 1 (2015): S237, Abstract 596.

Liu, W. et al. "Efficacy of a vectorized anti-tau antibody using systemic dosing of a blood brain barrier penetrant AAV capsid in mouse models of tauopathies." Alzheimer's & Dementia vol. 17, No. S9 (2021): e053341.

Marsic et al. "High-accuracy biodistribution analysis of adeno-associated virus variants by double barcode sequencing," Molecular Therapy—Methods & Clinical Development (2015) vol. 2, 15041.

Marsic, D. et al. "Vector design Tour de Force: integrating combinatorial and rational approaches to derive novel adeno-associated virus variants." Molecular Therapy : The Journal of the American Society of Gene Therapy vol. 22,11 (2014): 1900-9.

Maura, D. et al. "Discovery of Tracer AAV Capsids Escaping Pre-Existing Neutralizing Antibodies." Molecular Therapy, vol. 32 No 4S1 (2024): 475, Abstract 973.

(56) References Cited

OTHER PUBLICATIONS

Maura, D. et al. "Discovery of Tracer AAV Capsids Escaping Pre-existing Neutralizing Antibodies." Voyager Therapeutics. ASGCT 27th Annual Meeting 2024, May 7-11, 2024, Baltimore, MD, USA.
Moyer, T. "Continued directed evolution of VCAP-101 and VCAP-102 identifies second generation capsids with increased brain tropism in non-human primates and mice (#119)." Voyager Therapeutics. ASGCT 27th Annual Meeting. ASGCT 27th Annual Meeting 2024, May 7-11, 2024, Baltimore, MD, USA. Breaking Barriers to the CNS via AAV Capsid Engineering, Wednesday May 8, 2024.
Moyer, T. "Directed Evolution of AAV9 Peptide Display Libraries Identifies a Family of Cross-Species Variants With Enhanced Brain Tropism in Non-Human Primates and Mice Following Systemic Administration." Voyager Therapeutics. SGCT 2022—Novel AAV Capsids for the Brain, Eye, and Kidney, May 19, 2022.
Moyer, T. "Directed Evolution of an AAV9 Library Identifies a Capsid Variant with Enhanced Brain Tropism and Liver Detargeting in Non-Human Primates and Mice Following Systemic Administration." Voyager Therapeutics. AAV Engineering for CNS Targeting, Thursday, May 18, 2023, Abstract #105.
Moyer, T. et al. "Continued Directed Evolution of VCAP-101 and VCAP-102 Identifies Second Generation Capsid Variants with Increased Brain Tropism and in Non-Human Primates and Mice." Molecular Therapy, vol. 32 No 4S1 (2024): 64, Abstract 119.
Moyer, T. et al. "Directed Evolution of AAV9 Peptide Display Libraries Identifies a Family of Cross-Species Variants with Enhanced Brain Tropism in Non-Human Primates and Mice Following Systemic Administration." Molecular Therapy, vol. 30 No 4S1 (2022): 556, Abstract 1198.
Moyer, T. et al. "Directed Evolution of an AAV9 Library Identifies a Capsid Variant with Enhanced Brain Tropism and Liver De-Targeting in Non-Human Primates and Mice Following Systemic Administration." Molecular Therapy, vol. 31 No 4S1 (2023): 57, Abstract 105.
Moyer, T.C. et al. "Highly conserved brain vascular receptor ALPL mediates transport of engineered viral vectors across the blood-brain barrier," bioRxiv 2024.03.12.584703.
Nonnenmacher et al. "Rapid evolution of blood-brain barrier-penetrating AAV capsids by RNA-driven biopanning," Molecular Therapy (2021) vol. 20, pp. 366-378.
Nonnenmacher et al. "RNA-Driven Evolution of AAV Capsid Libraries Identifies Variants with High Transduction Efficiency in Non-Human Primate Central Nervous System," Molecular Therapy (2021) vol. 29, No. 4S1, pp. 25-26, Abstract 51.
Nonnenmacher et al. "Targeted In Vivo Biopanning of AAV Capsid Libraries Using Cell Type-Specific RNA Expression," Molecular Therapy (2019) vol. 27, No. 4S1, pp. 27, Abstract 48.
Nonnenmacher et al., "Dose-response evaluation of 9P801, an engineered AAV capsid with high BBB penetration and CNS transduction in non-human primates," ESGCT 29th Annual Congress In collaboration with BSGCT Edinburgh, UK Oct. 11-14, 2022 Abstract P015.Human Gene Therapy.Dec. 2022.
Nonnenmacher, M. "Iterative Evolution of Cross-Species BBB-Penetrant Capsids." Voyager Therapeutics. In Vivo Gene Therapy & Genome Editing Summit, Oct. 30-Nov. 2, 2023, Miami, FL, USA, talk was on Oct. 31, 2023.
Nonnenmacher, M. "TracerTM capsid discovery platform." Voyager Therapeutics. In Vivo Gene Therapy & Genome Editing Summit, Oct. 31-Nov. 2, 2022, Miami, FL, USA.
Nonnenmacher, M. et al. "Rapid evolution of blood-brain-barrier-penetrating AAV capsids by RNA-driven biopanning." Molecular Therapy: Methods & Clinical Development, vol. 20 (2021): 366-378.
Nonnenmacher. "RNA-driven Evolution of AAV Capsid Libraries Identifies Variants with High Transduction Efficiency in Non-Human Primate Central Nervous System," American Society of Cell + Gene Therapy Annual Meeting, 2021, 17 pages.
Ogden et al. "Comprehensive AAV capsid fitness landscape reveals a viral gene and enables machine-guided design," Science, 2019, 366(6469), pp. 1139-1143.
Pekrun et al. "Screening of Barcoded Capsid Shuffled AAV Libraries Results in the Selection of Capsids with Enhanced Transduction Efficiency for Human Islets," Molecular Therapy (2019) vol. 26, No. 5S1, pp. 41, Abstract 82.
Puglisi, M. et al. "Targeting astrocytes by non-invasive viral vectors and probing the influence of age and inducibile expression of the reprogramming factors in vivo." Presented at Cell State Conversions, Cold Spring Harbor Laboratory, New York, USA, Oct. 10-14, 2023.
Rees, H. A. and Liu, D. R. "Base editing: precision chemistry on the genome and transcriptome of living cells." Nature Reviews. Genetics vol. 19,12 (2018): 770-788.
Ren, X. et al. "Establishment of a Predictive Transcytosis Model to Recapitulate Capsid-Receptor Interaction and Phenotype of BBB Penetrant AAV Variants." Molecular Therapy, vol. 32 No 4S1 (2024): 476, Abstract 976.
Song et al. "Strong Alpha Cell Preference of the AAV Strains That Best Transduce Human Pancreatic Islets in Vitro," Molecular Therapy (2017) vol. 25, No. 5S1, pp. 47, Abstract 98.
Stanton, A. C. et al. "Systemic administration of novel engineered AAV capsids facilitates enhanced transgene expression in the macaque CNS." Med vol. 4, 1 (2023): 31-50.e8. Epub: Nov. 22, 2022.
Stoica, L. and Sena-Esteves, M. "Adeno Associated Viral Vector Delivered RNAi for Gene Therapy of SOD1 Amyotrophic Lateral Sclerosis." Frontiers in Molecular Neuroscience vol. 9 article 56 (2016).
Voyager Therapeutics, "Intravenous Delivery of Novel AAV Capsids", Oct. 20, 2017, Retrieved from the Internet: URL:https://www.voyagertherapeutics.com/wp-content/uploads/2017/10/ESGCT_slides.pdf [retrieved on Oct. 9, 2019].
Wang et al. "Adeno-associated virus vector as a platform for gene therapy delivery," Nat Rev Drug Discov., 2019, vol. 18, 5, pp. 358-378.
Yan et al., "Two-Amino Acid Molecular Switch in an Epithelial Morphogen That Regulates Binding to Two Distinct Receptors," Science (2000) vol. 290, pp. 523-527.
Yin, Z. et al., "Research Advances on Increasing the Transduction Efficiency of Recombinant Adeno-associated Viral Vectors." Biotechnology Bulletin vol. 31, 9 (2015): 49-59.
U.S. Appl. No. 18/703,166, filed Apr. 19, 2024, WO 2023/081648, Mathieu Emmanuel Nonnenmacher et al.
U.S. Appl. No. 18/862,369, filed Nov. 1, 2024, WO 2023/220695, Dan Richard Laks et al.
Abeliovich, A. et al. "Gene Therapy for Parkinson's Disease Associated with GBA1 Mutations." Journal of Parkinson's Disease vol. 11,s2 (2021): S183-S188.
Adachi et al. "A new recombinant adeno-associated virus (AAV)-based random peptide display library system: infection-defective AAV1.9-3 as a novel detargeted platform for vector evolution," Gene Therapy and Regulation (2010) vol. 5, pp. 31-55.
Adachi et al., "Drawing a high-resolution functional map of adeno-associated virus capsid by massively parallel sequencing," Nature Communications (2014) vol. 5, article 3075, 14 pages.
Adachi, M. et al. "A segment of the Mecp2 promoter is sufficient to drive expression in neurons." Human Molecular Genetics vol. 14,23 (2005): 3709-22.
Albright et al. "Modulation of sialic acid dependence influences the central nervous system transduction profile of adeno-associated viruses," Journal of Virology, 2019, vol. 93, Issue 11, pp. 1-15.
Anonymous: "capsid-associated protein VP80 [Spodoptera littoralis nucleopolyhedrovirus]—Protein—NCBI", (Feb. 15, 2013), pp. 1-1, Retrieved from the Internet: URL:https://www.ncbi.nlm.nih.gov/protein/AGE89944 [retrieved on Mar. 6, 2023].
Anonymous: "toxin-antitoxin system YwqK family antitoxin [Campylobacter sp. CCUG 57310]—Protein—NCBI", (Jun. 7, 2020), Retrieved from the Internet: URL:https://www.ncbi.nlm.nih.gov/protein/WP_173030534 [retrieved on Mar. 7, 2023].
Bryant et al. "Deep diversification of an AAV capsid protein by machine learning," Nature Biotechnology, 2021, vol. 39, pp. 691-696.
Büning, H. & Srivastava, A. "Capsid Modifications for Targeting and Improving the Efficacy of AAV Vectors." Molecular Therapy—Methods & Clinical Development vol. 12 (2019): 248-265.

(56) References Cited

OTHER PUBLICATIONS

Challis et al. "Systemic AAV vectors for widespread and targeted gene delivery in rodents," Nature Protocols (2019) vol. 14, pp. 379-414.

Chen et al. "Efficient Gene Delivery and Expression in Pancreas and Pancreatic Tumors by Capsid-Optimized AAV8 Vectors," Human Gene Therapy Methods (2017) vol. 28, No. 1, pp. 49-59.

Chen et al. "Targeting the Rodent Peripheral Nervous System Efficiently and with Greater Specificity through Intravenous Delivery of AAV Capsids Evolved by Multiplexed-CREATE," Molecular Therapy (2020) vol. 28, No. 4S1, pp. 252-253, Abstract 571.

Child, M.A. et al. "High-resolution Quantitative Analysis of Multiple AAV Capsids in Rodent and Primate Models Using Multiplexed Reporter Protein Tagging Platform." Voyager Therapeutics. ASGCT 27th Annual Meeting 2024, May 7-11, 2024, Baltimore, MD, USA.

Choi et al., "AAV Hybrid Serotypes: Improved Vectors for Gene Delivery," Current Gene Therapy (2005) vol. 5, No. 3, pp. 209-210.

Davidsson et al. "A systematic capsid evolution approach performed in vivo for the design of AAV vectors with tailored properties and tropism," PNAS, 2019, vol. 116, No. 52, pp. 27053-27062.

Deverman et al. "Cre-dependent selection yields AAV variants for widespread gene transfer to the adult brain," Nat Biotechnol. (2016) vol. 34, No. 2, pp. 204-209.

Dimattia et al., "Structural Insight into the Unique Properties of Adeno-Associated Virus Serotype 9," J Virol (2012) vol. 86, No. 12, pp. 6947-6958.

Fischell, J.M. and Fishman, P.S. "A Multifaceted Approach to Optimizing AAV Delivery to the Brain for the Treatment of Neurodegenerative Diseases." Frontiers in Neuroscience vol. 15, article 747726 (2021).

Flytzanis et al. "Broad gene expression throughout the mouse and marmoset brain after intravenous delivery of engineered AAV capsids," bioRxiv Preprint Server (2020) Doi: https://doi.org/10.1101/2020.06.16.152975, 21 pages.

Gao, G. et al. "Clades of Adeno-associated viruses are widely disseminated in human tissues," Journal of Virology vol. 78,12 (2004): 6381-8.

Gessler et al., "Intravenous infusion of AAV for widespread gene delivery to the nervous system," Methods Mol. Biol., 2019, vol. 1950, pp. 143-163.

Goertsen et al. "AAV capsid variants with brain-wide transgene expression and decreased liver targeting after intravenous delivery in mouse and marmoset," Nature Neuroscience, 2022, vol. 25, pp. 106-115.

Goertsen et al. "Transduction Profiles of Engineered Adeno-Associated Viral Capsids in Mouse and Marmoset," Molecular Therapy (2020) vol. 28, No. 4S1, pp. 269-270, Abstract 609.

Grannan, M.D. et al. "Intravenous Delivery of AAV Gene Therapy for the Treatment of SOD1-ALS Provides Broad SOD1 Lowering in NHP." Molecular Therapy, vol. 32 No. 4S1 (2024): 769-770, Abstract 1647.

Grannan, M.D. et al. "Intravenous Delivery of AAV Gene Therapy for the Treatment of SOD1-ALS Provides Broad SOD1 Lowering in NHP." Voyager Therapeutics. ASGCT 27th Annual Meeting 2024, May 7-11, 2024, Baltimore, MD, USA.

Gray, S.J. et al. "Optimizing promoters for recombinant adeno-associated virus-mediated gene expression in the peripheral and central nervous system using self-complementary vectors." Human Gene Therapy vol. 22,9 (2011): 1143-53.

Hanlon et al. "Selection of an efficient AAV vector for robust CNS transgene expression," Molecular Therapy: Methods & Clinical Development, 2019, vol. 15, pp. 320-332.

Hoffman, B. et al. "Identification and Characterization of a Highly Conserved Cell Surface Receptor Utilized by Engineered BBB-Penetrant AAV Capsids with Enhanced Brain Tropism in Non-Human Primates and Mice." Voyager Therapeutics. ASGCT 27th Annual Meeting 2024, May 7-11, 2024, Baltimore, MD, USA.

Hoffman, B. et al. "Identification and Characterization of a Highly Conserved Cell Surface Receptor Utilized by Engineered BBB-Penetrant AAV Capsids with Enhanced Brain Tropism in Non-Human Primates and Mice." Molecular Therapy, vol. 32 No 4S1 (2024): 475, Abstract 975.

Hoffman, B. et al. "Identification of a cell surface receptor utilized by an engineered BBB-penetrant capsid family with enhanced brain tropism in non-human primates and mice." Human Gene Therapy vol. 33: A2-A212 (Dec. 2022), A32, Abstract P024.

Hoffman, B.A. et al. "Discovery and Characterization of Novel Cross-Species BBB-Penetrant Capsids." Voyager Therapeutics. ASGCT 26th Annual Meeting 2023, May 16-20, 2023, Los Angeles, CA, USA.

Hoffman, B.A. et al. "Identification of a Cell Surface Receptor Utilized by an Engineered BBB-Penetrant Capsid Family with Enhanced Brain Tropism in Non-Human Primates and Mice." Voyager Therapeutics. ESGCT—29th Congress, Oct. 11-14, 2022, Edinburgh, Scotland, UK.

Huang et al. "Cell Type-Specific TRAnscriptionDependent Directed Evolution (TRADE) Identifies Novel AAV Capsids Capable of Enhanced Neuronal Transduction in Mice and Non-Human Primates," Molecular Therapy (2019) vol. 27, No. 4S1, pp. 24-25, Abstract 44.

Huang et al. "Delivering genes across the blood-brain barrier: LY6A, a novel cellular receptor for AAV-PHP.B capsids," PLOS One (2019) vol. 14, No. 11, e0225206, pp. 1-17.

Ibe, M.et al. "Role of strong anchor residues in the effective binding of 10-mer and 11-mer peptides to HLA-A*2402 molecules," Immunogenetics vol. 44, 4, (1996): 233-241.

International Search Report and Written Opinion for International Application No. PCT/US2021/025061 dated Sep. 20, 2021.

International Search Report and Written Opinion for International Patent Application No. PCT/US2021/025072 dated Jul. 26, 2021.

International Search Report and Written Opinion from International Patent Application No. PCT/US2019/054345 dated Jan. 24, 2020.

International Search Report and Written Opinion in International Patent Application No. PCT/US2022/079060 dated Mar. 6, 2023.

International Search Report and Written Opinion in International Patent Application No. PCT/US2022/079963 dated May 9, 2023.

International Search Report and Written Opinion in International Patent Application No. PCT/US2022/080035 dated Apr. 3, 2023.

International Search Report and Written Opinion in International Patent Application No. PCT/US2022/080040 dated Mar. 1, 2023.

International Search Report and Written Opinion in International Patent Application No. PCT/US2023/067749 dated Sep. 29, 2023.

International Search Report and Written Opinion of International Patent Application No. PCT/US2022/079964 dated Jun. 9, 2023.

Invitation to Pay Additional Fees and Partial Search Report from International Application No. PCT/US2021/025061 dated Jul. 27, 2021.

Ishan, S. et al. "Establishment of a Predictive Transcytosis Model to Recapitulate Capsid-Receptor Interaction and Phenotype of BBB-penetrant AAV Variant." Voyager Therapeutics. ASGCT 27th Annual Meeting 2024, May 7-11, 2024, Baltimore, MD, USA.

Ising, C. et al. "AAV-mediated expression of anti-tau scFvs decreases tau accumulation in a mouse model of tauopathy." The Journal of Experimental Medicine vol. 214, 5 (2017): 1227-1238.

Khalid, A. et al. "Evaluation of Cross-species Expression Across Four Species and Cellular Tropism of VCAP-102, an Engineered Blood-brain Barrier-penetrating AAV Derived Capsid from TRACER Platform Screens." Voyager Therapeutics. ASGCT 27th Annual Meeting 2024, May 7-11, 2024, Baltimore, MD, USA.

Khalid, H. et al. "Evaluation of Cross-Species Expression Across Four Species and Cellular Tropism of VCAP-102, an Engineered Blood-Brain Barrier-Penetrating AAV." Molecular Therapy, vol. 32 No 4S1 (2024): 685, Abstract 1452.

Kienle et al. "Secrets to finding the ideal mate: New insights into parameters that govern successful Adeno-associated virus (AAV) vector evolution," Dissertation, University Heidelberg (2014) pp. 1-194.

Kotchey, N. M. et al. "A potential role of distinctively delayed blood clearance of recombinant adeno-associated virus serotype 9 in

(56) References Cited

OTHER PUBLICATIONS robust cardiac transduction." Molecular Therapy : The Journal of the American Society of Gene Therapy vol. 19,6 (2011): 1079-89.
Qiao, C. et al. "Liver-specific microRNA-122 target sequences incorporated in AAV vectors efficiently inhibits transgene expression in the liver." Gene Therapy vol. 18,4 (2011): 403-10.

AAV CAPSID VARIANTS AND USES THEREOF

RELATED APPLICATIONS

This application is a continuation of U.S. patent application Ser. No. 18/703,166 filed Apr. 19, 2024, which is a U.S. National Phase Application under 35 U.S.C. § 371 of International Application No. PCT/US2022/079060, filed Nov. 1, 2022, which claims priority to U.S. Provisional Application No. 63/274,806 filed on Nov. 2, 2021 and U.S. Provisional Application No. 63/339,711 filed on May 9, 2022; the entire contents of each of which are hereby incorporated by reference in their entirety.

SEQUENCE LISTING

The instant application contains a Sequence Listing which has been submitted electronically in XML format and is hereby incorporated by reference in its entirety. Said XML copy, created on Oct. 19, 2022, is named V2071-1125PCT-_SL.xml and is 5,455,496 bytes in size.

FIELD OF THE DISCLOSURE

The disclosure relates to compositions and methods for the preparation, use, and/or formulation of adeno-associated virus capsid proteins and variants thereof.

BACKGROUND

Gene delivery to the adult central nervous system (CNS) remains a significant challenge in gene therapy. Engineered adeno-associated virus (AAV) capsids with improved brain tropism represent an attractive solution to the limitations of CNS delivery.

AAV-derived vectors are promising tools for clinical gene transfer because of their non-pathogenic nature, their low immunogenic profile, low rate of integration into the host genome and long-term transgene expression in non-dividing cells. However, the transduction efficiency of AAV natural variants in certain organs is too low for clinical applications, and capsid neutralization by pre-existing neutralizing antibodies may prevent treatment of a large proportion of patients. For these reasons, considerable efforts have been devoted to obtaining capsid variants with enhanced properties. Of many approaches tested so far, significant advances have resulted from directed evolution of AAV capsids using in vitro or in vivo selection of capsid variants created by capsid sequence randomization using either error-prone PCR, shuffling of various parent serotypes, or insertion of fully randomized short peptides at defined positions.

Attempts at providing AAV capsids with improved properties, e.g., improved tropism to a target cell or tissue upon systemic administration, have met with limited success. As such, there is a need for improved methods of producing AAV capsids and resulting AAV capsids for delivery of a payload of interest to a target cell or tissue, e.g., a CNS cell or tissue, or a muscle cell or tissue.

SUMMARY OF THE DISCLOSURE

The present disclosure pertains at least in part, to compositions and methods for the production and use of an AAV particle comprising an AAV capsid polypeptide, e.g., an AAV capsid variant. In some embodiments, the AAV capsid variant has an enhanced tropism for a tissue or a cell, e.g., a CNS tissue or a CNS cell. Said tropism can be useful for delivery of a payload, e.g., a payload described herein to a cell or tissue, for the treatment of a disorder, e.g., a neurological or a neurodegenerative disorder, a muscular or a neuromuscular disorder, or a neuro-oncological disorder.

Accordingly, in one aspect, the present disclosure provides an AAV capsid variant, comprising an amino acid sequence having the following formula: [N1]-[N2]-[N3], wherein: (i) optionally [N1] comprises X1, X2, and X3, wherein at least one of X1, X2, or X3 is G; (ii) [N2] comprises the amino acid sequence of SPH; (ii) [N3] comprises X4, X5, and X6, wherein at least one of X4, X5, or X6 is a basic amino acid, e.g., a K or R. In some embodiments, position X4 of [N3] is K. In some embodiments, position X5 of [N3] is K. In some embodiments, [N3] is or comprises SKA. In some embodiments [N3] is or comprises KSG. In some embodiments, [N2]-[N3] is present immediately subsequent to position 455, numbered according to SEQ ID NO: 138, 981 or 982. In some embodiments, [N1] is present immediately subsequent to position 452, relative to a reference sequence numbered according to the amino acid sequence of SEQ ID NO: 138, 981, or 982. In some embodiments, [N1] replaces positions 453-455 (e.g., G453, S454, and G455), relative to a reference sequence numbered according to SEQ ID NO: 138. In some embodiments, the AAV capsid variant comprises H at position 454 and D at position 455, numbered according to SEQ ID NO: 138 or 982. In some embodiments, the AAV capsid variant comprises S at position 454 and G at position 455, numbered according to SEQ ID NO: 138 or 981. In some embodiments, an insert of 8 amino acids replaces the SG at positions 454-455, numbered according to SEQ ID NO: 138. In some embodiments, an insert of 6 amino acids is present immediately subsequent to position 455, numbered according to SEQ ID NO: 138, 981, or 982.

In another aspect, the present disclosure provides an AAV capsid variant comprising [A][B] (SEQ ID NO: 4694), wherein: (i) [A] comprises the amino acid sequence of GSGSPH (SEQ ID NO: 4695); and (ii) [B] comprises X1 X2 X3 X4 X5 X6 X7, wherein: (a) position X1 is S, C, F, or V; (b) position X2 is K, L, R, I, E, Y, V, or S; (c) position X3 is A, R, L, G, I, Y, S, F, or W; (d) position X4 is W, Q, R, G, L, V, S, or F; (e) position X5 is N, Y, R, C, K, or L; (f) position X6 is Q, G, K, R, T, L, or Y; and (g) position X7 is Q, L, R, or V.

In yet another aspect, the present disclosure provides an AAV capsid variant comprising [A][B] (SEQ ID NO: 4699) wherein: (i) [A] comprises X1 X2 X3 X4 X5 X6, wherein (a) position X1 is T, M, A, C, I, R, L, D, F, V, Q, N, or H; (b) position X2 is I, P, E, N, D, S, A, T, M, or Q; (c) position X3 is N, E, G, Y, W, M, T, I, K, Q, F, S, V, A, or L; (d) position X4 is G, D, R, or E; (e) position X5 is H, Q, N, or D; (f) position X6 is D or R; and (ii) [B] comprises SPHKSG (SEQ ID NO: 946).

In yet another aspect, the present disclosure provides an AAV capsid variant comprising an amino acid sequence having the following formula: [N1]-[N2]-[N3] (SEQ ID NO: 6407), wherein: (i) [N1] comprises positions X1, X2, and X3, wherein position X2 is S and position X3 is G; (ii) [N2] comprises the amino acid sequence SPH; and (iii) [N3] comprises positions X4, X5, and X6, wherein position X5 is K. In some embodiments, [N1]-[N2]-[N3] is present immediately subsequent to position 452 and replaces positions 453-455, numbered according to SEQ ID NO: 138 or 982. In some embodiments, [N1]-[N2]-[N3] is or comprises GSGSPHSKA (SEQ ID NO: 4697).

In another aspect, the present disclosure provides an AAV capsid variant comprising an amino acid sequence having the following formula: [N1]-[N2]-[N3] (SEQ ID NO: 6408), wherein: (i) [N1] comprises positions X1, X2, and X3, wherein position X2 is an amino acid other than S and position X3 is an amino acid other than G; (ii) [N2] comprises the amino acid sequence SPH; and (iii) [N3] comprises positions X4, X5, and X6, wherein position X4 is K. In some embodiments, [N1]-[N2]-[N3] is present immediately subsequent to position 452 and replaces positions 453-455, numbered according to SEQ ID NO: 138 or 982. In some embodiments, [N1]-[N2]-[N3] is or comprises GHDSPHKSG (SEQ ID NO: 4698).

In yet another aspect, the present disclosure provides an AAV capsid variant comprising the formula [A]-[B] (SEQ ID NO: 4696), wherein: (i) [A] comprises GSGSPH (SEQ ID NO: 4695); and (ii) [B] comprises X1 X2, X3, X4, and X5, wherein: (a) position X1 is S, I, F, V, C, Y, W, R, P, L, Q, M, K, or G; (b) position X2 is K, M, R, F, V, C, P, Y, L, W, G, N, S, T, I, or A; (c) position X3 is A, Y, L, R, W, C, T, F, H, I, P, M, K, S, V, G, Q, or N; (d) position X4 is Q, M, F, K, H, R, C, W, P, V, L, G, S, Y, I, A, T, D, N, or E; and (e) position X5 is A, N, Y, R, K, L, I, M, Q, S, C, W, F, T, G, V, or P; optionally wherein the AAV capsid variant comprises an amino acid modification, e.g., a conservative substitution, of any of the aforesaid amino acids in (a)-(e). In some, embodiments, [A]-[B] is present immediately subsequent to position 452, and wherein [A]-[B] replaces positions 453-457 (e.g., G453, S454, G455, Q456, N457), relative to a reference sequence numbered according to the amino acid sequence of SEQ ID NO: 138. In some embodiments, the AAV capsid variant has increased tropism for a liver cell or tissue, relative to the tropism of a reference sequence comprising the amino acid sequence of SEQ ID NO: 138. In some embodiments, the AAV capsid shows preferential transduction in the liver relative to transduction in the brain and/or dorsal root ganglia (DRG), e.g., as compared to SEQ ID NO: 138.

In another aspect, the present disclosure provides an AAV capsid variant comprising (a) the amino acid sequence of any of the sequences provided in Tables 1, 2A, 2B, 13-19; (b) an amino acid sequence comprising at least 3, 4, 5, 6, 7, 8, 9, 10, 11, 12, 13, 14, 15, 16, or 17, consecutive amino acids from any one of the sequences provided in Tables 1, 2A, 2B, 13-19; (c) an amino acid sequence comprising at least one, two, or three, but no more than four different amino acids, relative to any one of the sequences provided in Tables 1, 2A, 2B, 13-19; or (d) an amino acid sequence comprising at least one, two, or three but no more than four modifications, e.g., substitutions (e.g., conservative substitutions), relative to the amino acid sequence of any one of the sequences provided in Tables 1, 2A, 2B, 13-19. In some embodiments, the amino acid sequence is present in loop IV. In some embodiments, the amino acid sequence is present immediately subsequent to position 448, 452, 453, 455, relative to a reference sequence numbered according to the amino acid sequence of SEQ ID NO: 138.

In yet another aspect, the present disclosure provides an AAV capsid variant comprising (a) the amino acid sequence of any of SEQ ID NOs: 945-980 or 985-986; (b) an amino acid sequence comprising at least 3, 4, or 5 consecutive amino acids from any one of SEQ ID NOs: 945-980 or 985-986; (c) an amino acid sequence comprising at least one, two, or three but no more than four different amino acids, relative to the amino acid sequence of any one of SEQ ID NOs: 945-980 or 985-986; (d) an amino acid sequence comprising at least one, two, or three but no more than four modifications, e.g., substitutions (e.g., conservative substitutions), relative to the amino acid sequence of any one of SEQ ID NOs: 945-980 or 985-986. In some embodiments, the amino acid sequence is present in loop IV. In some embodiments, the amino acid sequence is present immediately subsequent to position 448, 452, 453, 455, relative to a reference sequence numbered according to the amino acid sequence of SEQ ID NO: 138.

In yet another aspect, the present disclosure provides an AAV capsid variant comprising (a) the amino acid sequence of any of SEQ ID NOs: 2, 200, 201, 941, 943, 204, 208, 404, or 903-909; (b) an amino acid sequence comprising at least 3, 4, 5, 6, 7, 8, 9, 10, 11, 12, or 13 consecutive amino acids from any one of SEQ ID NOs: 2, 200, 201, 941, 943, 204, 208, 404, or 903-909; (c) an amino acid sequence comprising at least one, two, or three, but no more than four different amino acids, relative to the amino acid sequence of any one of SEQ ID NOs: 2, 200, 201, 941, 943, 204, 208, 404, or 903-909; or (d) an amino acid sequence comprising at least one, two, or three but no more than four modifications, e.g., substitutions (e.g., conservative substitutions), relative to the amino acid sequence of any one of SEQ ID NOs: 2, 200, 201, 941, 943, 204, 208, 404, or 903-909. In some embodiments, the amino acid sequence is present in loop IV. In some embodiments, the amino acid sequence is present immediately subsequent to position 448, 452, 453, 455, relative to a reference sequence numbered according to the amino acid sequence of SEQ ID NO: 138.

In yet another aspect, the present disclosure provides a polynucleotide encoding an AAV capsid variant described herein. In some embodiments, the polynucleotide comprises (i) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequences of SEQ ID NO: 3 or 942; (ii) a nucleotide sequence comprising at least one, two, three, four, five, six, or seven, but no more than ten different nucleotides, relative to the nucleotide sequences of SEQ ID NO: 3 or 942; or (iii) the nucleotide sequence of SEQ ID NOs: 3 or 942, or nucleotide sequence substantially identical (e.g., having at least 70%, 75%, 80%, 85%, 90%, 92%, 95%, 97%, 98%, or 99% sequence identity) thereto.

In yet another aspect, present disclosure provides an AAV capsid variant comprising an amino acid sequence comprising at least 3, 4, 5, or 6 consecutive amino acids from the amino acid sequence of SPHSKA (SEQ ID NO: 941), wherein: (i) the 3 consecutive amino acids comprise SPH; (ii) the 4 consecutive amino acids comprise SPHS (SEQ ID NO: 4700); (iii) the 5 consecutive amino acids comprise SPHSK (SEQ ID NO: 4701); or (iv) the 6 consecutive amino acids comprise SPHSKA (SEQ ID NO: 941); wherein the AAV capsid variant comprises: (a) a VP1 protein comprising the amino acid sequence of SEQ ID NO: 138 or SEQ ID NO: 981; (b) a VP2 protein comprising the amino acid sequence of positions 138-736 of SEQ ID NO: 138 or positions 138-742 of SEQ ID NO: 981; (c) a VP3 protein comprising the amino acid sequence of positions 203-736 of SEQ ID NO: 138 or positions 203-742 of SEQ ID NO: 981; or (d) an amino acid sequence with at least 90% (e.g., at least about 95, 96, 97, 98, or 99%) sequence identity to any of the amino acid sequences in (a)-(c). In some embodiments, the amino acid sequence is present immediately subsequent to positions 455, numbered according to SEQ ID NO: 138 or 981.

In yet another aspect, the present disclosure provides an AAV capsid variant comprising one or two, but no more than three substitutions relative to the amino acid sequence of SPHSKA (SEQ ID NO: 941), wherein the AAV capsid variant comprises: (a) a VP1 protein comprising the amino acid sequence of SEQ ID NO: 138 or SEQ ID NO: 981; (b) a VP2 protein comprising the amino acid sequence of positions 138-736 of SEQ ID NO: 138 or positions 138-742 of SEQ ID NO: 981; (c) a VP3 protein comprising the amino acid sequence of positions 203-736 of SEQ ID NO: 138 or positions 203-742 of SEQ ID NO: 981; or (d) an amino acid sequence with at least 90% (e.g., at least about 95, 96, 97, 98, or 99%) sequence identity to any of the amino acid sequences in (a)-(c). In some embodiments, the amino acid sequence is present immediately subsequent to positions 455, numbered according to SEQ ID NO: 138 or 981.

In another aspect, the present disclosure provides an AAV capsid variant comprising at least 3, 4, 5, or 6 consecutive amino acids from the amino acid sequence of HDSPHK (SEQ ID NO: 2), wherein: (i) the 3 consecutive amino acids comprise HDS; (ii) the 4 consecutive amino acids comprise HDSP (SEQ ID NO: 4702); (iii) the 5 consecutive amino acids comprise HDSPH (SEQ ID NO: 4703); and/or (iv) the 6 consecutive amino acids comprise HDSPHK (SEQ ID NO: 2); wherein the AAV capsid variant comprises: (a) a VP1 protein comprising the amino acid sequence of SEQ ID NO: 138 or SEQ ID NO: 982; (b) a VP2 protein comprising the amino acid sequence of positions 138-736 of SEQ ID NO: 138 or positions 138-742 of SEQ ID NO: 982; (c) a VP3 protein comprising the amino acid sequence of positions 203-736 of SEQ ID NO: 138 or positions 203-742 of SEQ ID NO: 982; or (d) an amino acid sequence with at least 90% (e.g., at least about 95, 96, 97, 98, or 99%) sequence identity to any of the amino acid sequences in (a)-(c). In some embodiments, the amino acid sequence is present immediately subsequent to positions 453, numbered according to SEQ ID NO: 138 or 982.

In another aspect, the present disclosure provides an AAV capsid variant comprising one or two, but no more than three substitutions relative to the amino acid sequence of HDSPHK (SEQ ID NO: 2), wherein the AAV capsid variant comprises: (a) a VP1 protein comprising the amino acid sequence of SEQ ID NO: 138 or SEQ ID NO: 982; (b) a VP2 protein comprising the amino acid sequence of positions 138-736 of SEQ ID NO: 138 or positions 138-742 of SEQ ID NO: 982; (c) a VP3 protein comprising the amino acid sequence of positions 203-736 of SEQ ID NO: 138 or positions 203-742 of SEQ ID NO: 982; or (d) an amino acid sequence with at least 90% (e.g., at least about 95, 96, 97, 98, or 99%) sequence identity to any of the amino acid sequences in (a)-(c).

In yet another aspect, the present disclosure provides a peptide comprising: (a) the amino acid sequence of any of the sequences provided in Tables 1, 2A, 2B, 13-19; (b) an amino acid sequence comprising at least 3, 4, 5, 6, 7, 8, 9, 10, 11, 12, 13, 14, 15, 16, or 17 consecutive amino acids from any one of the sequences provided in Tables 1, 2A, 2B, 13-19; (c) an amino acid sequence comprising at least one, two, or three, but no more than four different amino acids relative to the amino acid sequence of any one of the sequences provided in Tables 1, 2A, 2B, 13-19; or (d) an amino acid sequence comprising at least one, two, or three but no more than four modifications, e.g., substitutions (e.g., conservative substitutions), relative to the amino acid sequence of any one of the sequences provided in Tables 1, 2A, 2B, 13-19.

In another aspect, the present disclosure provides a peptide comprising (a) the amino acid sequence of any of SEQ ID NOs: 945-980 or 985-986; (b) an amino acid sequence comprising at least 3, 4, or 5 consecutive amino acids from any one of SEQ ID NOs: 945-980 or 985-986; (c) an amino acid sequence comprising at least one, two, or three, but no more than four different amino acids relative to the amino acid sequence of any one of SEQ ID NOs: 945-980 or 985-986; or (d) an amino acid sequence comprising at least one, two, or three but no more than four modifications, e.g., substitutions (e.g., substitutions), relative to the amino acid sequence of any one of SEQ ID NOs: 945-980 or 985-986.

In another aspect, the present disclosure provides a peptide comprising: (a) the amino acid sequence of any of SEQ ID NOs: 2, 200, 201, 941, 943, 204, 208, 404, or 903-909; (b) an amino acid sequence comprising at least 3, 4, 5, 6, 7, 8, 9, 10, 11, 12, or 13 consecutive amino acids from any one of SEQ ID NOs: 2, 200, 201, 941, 943, 204, 208, 404, or 903-909; or (c) an amino acid sequence comprising at least one, two, or three but no more than four different amino acids relative to the amino acid sequence of any one of SEQ ID NOs: 2, 200, 201, 941, 943, 204, 208, 404, or 903-909; or (d) an amino acid sequence comprising at least one, two, or three but no more than four modifications, e.g., substitutions (conservative substitutions), relative to the amino acid sequence of any one of SEQ ID NOs: 2, 200, 201, 941, 943, 204, 208, 404, or 903-909.

In yet another aspect, the present disclosure provides a peptide comprising: (i) the amino acid sequence of SPHSKA (SEQ ID NO: 941); (ii) an amino acid sequence comprising at least one, two, or three, but no more than four different amino acids relative to the amino acid sequence of SPHSKA (SEQ ID NO: 941); (iii) an amino acid sequence comprising at least one, two, or three modifications, e.g., substitutions (e.g., conservative substitutions), but no more than four modifications, e.g., substitutions (e.g., conservative substitutions), relative to the amino acid sequence of SPHSKA (SEQ ID NO: 941); or (iv) at least 3, 4, or 5 consecutive amino acids from the amino acid sequence of SPHSKA (SEQ ID NO: 941).

In yet another aspect, the present disclosure provides a peptide encoded by (i) the nucleotide sequence of SEQ ID NO: 942, or a nucleotide sequence substantially identical (e.g., having at least 70%, 75%, 80%, 85%, 90%, 92%, 95%, 97%, 98%, or 99% sequence identity) thereto; or (ii) a nucleotide sequence comprising at least one, two, three, four, five, six, or seven, but no more than ten different nucleotides relative to the nucleotide sequence of SEQ ID NO: 942; or (iii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 942.

In yet another aspect, the present disclosure provides a peptide, wherein the nucleotide sequence encoding the peptide comprises (i) the nucleotide sequence of SEQ ID NO: 942, or a nucleotide sequence substantially identical (e.g., having at least 70%, 75%, 80%, 85%, 90%, 92%, 95%, 97%, 98%, or 99% sequence identity) thereto; (ii) a nucleotide sequence comprising at least one, two, three, four, five, six, or seven, but not more than 10 different nucleotides, relative to the nucleotide sequence of SEQ ID NO: 942; or (iii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 942.

In another aspect, the present disclosure provides a peptide comprising: (i) the amino acid sequence of HDSPHK (SEQ ID NO: 2); (ii) an amino acid sequence comprising at least one, two, or three, but no more than four different amino acids, relative to the amino acid sequence of HDSPHK (SEQ ID NO: 2); (iii) an amino acid sequence comprising at least one, two, or three modifications, e.g., substitutions (e.g., conservative substitutions), but no more than four modifications, e.g., substitutions (e.g., conservative substitutions), relative to the amino acid sequence of HDSPHK (SEQ ID NO: 2); or (iv) at least 3, 4, or 5 consecutive amino acids from the amino acid sequence of HDSPHK (SEQ ID NO: 2).

In yet another aspect, the present disclosure provides a peptide encoded by (i) the nucleotide sequence of SEQ ID NO: 3, or a nucleotide sequence substantially identical (e.g., having at least 70%, 75%, 80%, 85%, 90%, 92%, 95%, 97%, 98%, or 99% sequence identity) thereto; (ii) a nucleotide sequence comprising at least one, two, three, four, five, six, or seven, but no more than ten different nucleotides, relative to the nucleotide sequence of SEQ ID NO: 3; (iii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 3.

In another aspect, the present disclosure provides a peptide wherein the nucleotide sequence encoding the peptide comprises: (i) the nucleotide sequence of SEQ ID NO: 3, or a nucleotide sequence substantially identical (e.g., having at least 70%, 75%, 80%, 85%, 90%, 92%, 95%, 97%, 98%, or 99% sequence identity) thereto; (ii) a nucleotide sequence comprising at least one, two, three, four, five, six, or seven, but no more than ten different nucleotides relative to the nucleotide sequence of SEQ ID NO: 3; or (iii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 3.

In yet another aspect, the present disclosure provides a polynucleotide encoding an AAV capsid variant comprising: (a) the amino acid sequence of any of the sequences provided in Tables 1, 2A, 2B, 13-19; (b) an amino acid sequence comprising at least 3, 4, 5, 6, 7, 8, 9, 10, 11, 12, 13, 14, 15, 16, or 17 consecutive amino acids from any one of the sequences provided in Tables 1, 2A, 2B, 13-19; (c) an amino a sequence comprising at least one, two, or three but no more than four different amino acids, relative to the amino acid sequence of any one of the sequences provided in Tables 1, 2A, 2B, 13-19; or (d) an amino acid sequence comprising at least one, two, or three but no more than four modifications, e.g., substitutions (conservative substitutions), relative to the amino acid sequence of any one of the sequences provided in Tables 1, 2A, 2B, 13-19. In some embodiments, the amino acid sequence of (a), (b), (c), and/or (d) is present immediately subsequent to position 448, 449, 450, 451, 452, 453, 454, or 455, relative to a reference sequence numbered according to the amino acid sequence of SEQ ID NO: 138.

In yet another aspect, the present disclosure provides a polynucleotide encoding an AAV capsid variant, wherein the AAV capsid variant comprises: (i) the amino acid sequence of SPHSKA (SEQ ID NO: 941); (ii) an amino acid sequence comprising at least one, two, or three, but no more than four different amino acids, relative to the amino acid sequence of SPHSKA (SEQ ID NO: 941); (iii) an amino acid sequence comprising at least one, two, or three modifications, e.g., substitutions (e.g., conservative substitutions), but no more than four modifications, e.g., substitutions (e.g., conservative substitutions), relative to the amino acid sequence of SPHSKA (SEQ ID NO: 941); or (iv) at least 3, 4, 5, 6, 7, 8, or 9 consecutive amino acids from the amino acid sequence of SPHSKA (SEQ ID NO: 941). In some embodiments, the amino acid sequence of (i), (ii), (iii), and/or (iv) is present immediately subsequent to position 455, relative to a reference sequence numbered according to the amino acid sequence of SEQ ID NO: 138.

In another aspect, the present disclosure provides a polynucleotide encoding an AAV capsid variant, wherein the AAV capsid variant comprises: (i) the amino acid sequence of HDSPHK (SEQ ID NO: 2); (ii) an amino acid sequence comprising at least one, two, or three, but no more than four different amino acids, relative to the amino acid sequence of HDSPHK (SEQ ID NO: 2); (iii) an amino acid sequence comprising at least one, two, or three modifications, e.g., substitutions (e.g., conservative substitutions), but no more than four modifications, e.g., substitutions (e.g., conservative substitutions), relative to the amino acid sequence of HDSPHK (SEQ ID NO: 2); or (iv) at least 3, 4, 5, or 6 consecutive amino acids from the amino acid sequence of HDSPHK (SEQ ID NO: 2). In some embodiments, the amino acid sequence of (i), (ii), (iii), and/or (iv) is present immediately subsequent to position 453, relative to a reference sequence numbered according to the amino acid sequence of SEQ ID NO: 138.

In yet another aspect, the present disclosure provides an AAV capsid variant comprising the amino acid sequence of SPH, wherein the amino acid sequence is present immediately subsequent to position 455, numbered according to the amino acid sequence of any one of SEQ ID NOs: 36-59, 138, 981, or 982.

In yet another aspect, the present disclosure provides an AAV capsid variant comprising the amino acid sequence of SPHSKA (SEQ ID NO: 941), wherein the amino acid sequence is present immediately subsequent to position 455, numbered according to the amino acid sequence of SEQ ID NO: 138.

In yet another aspect, the present disclosure provides an AAV capsid variant comprising the amino acid sequence of SPHSKA (SEQ ID NO: 941), wherein the amino acid sequence is present immediately subsequent to position 455, numbered according to the amino acid sequence of SEQ ID NO: 981.

In yet another aspect, the present disclosure provides an AAV capsid variant comprising the amino acid sequence of HDSPHK (SEQ ID NO: 2), wherein the amino acid sequence is present immediately subsequent to position 453, numbered according to the amino acid sequence of SEQ ID NO: 138.

In yet another aspect, the present disclosure provides an AAV capsid variant comprising the amino acid sequence of HDSPHK (SEQ ID NO: 2), wherein the amino acid sequence is present immediately subsequent to position 453, numbered according to the amino acid sequence of SEQ ID NO: 982.

In yet another aspect, the present disclosure provides an AAV capsid variant comprising the amino acid sequence of SPHSKA (SEQ ID NO: 941), wherein the amino acid sequence is present in loop IV, relative to a reference sequence of SEQ ID NO: 138. In some embodiments, loop IV comprises positions 449-460, numbered according to SEQ ID NO: 138.

In yet another aspect, the present disclosure provides an AAV capsid variant comprising the amino acid sequence of HDSPHK (SEQ ID NO: 2), wherein the amino acid sequence is present in loop IV, relative to a reference sequence of SEQ ID NO: 138. In some embodiments, loop IV comprises positions 449-460, numbered according to SEQ ID NO: 138.

In yet another aspect, the present disclosure provides an AAV particle comprising an AAV capsid variant, described herein. In some embodiments, the AAV particle comprises a nucleic acid sequence encoding a payload. In some embodiments, the AAV particle further comprises a viral genome comprising a promoter operably linked to the nucleic acid encoding the payload.

In yet another aspect, the present disclosure provides a method of making an AAV particle comprising an AAV capsid variant described herein. The method comprises providing a host cell comprising a viral genome and incubating the host cell under conditions suitable to enclose the viral genome in the AAV capsid variant, e.g., an AAV capsid variant described herein, thereby making the AAV particle.

In yet another aspect, the present disclosure provides a method of delivering a payload to a cell or tissue (e.g., a CNS cell, a CNS tissue, a liver cell, or a liver tissue). The method comprising administering an effective amount of an AAV particle comprising an AAV capsid variant described herein.

In yet another aspect, the present disclosure provides a method of treating a subject having or diagnosed with having a genetic disorder, e.g., a monogenic disorder or a polygenic disorder. The method comprising administering to the subject an effective amount an AAV particle comprising an AAV capsid variant described herein.

In yet another aspect, the present disclosure provides a method of treating a subject having or diagnosed with having neurological, e.g., a neurodegenerative, disorder. The method comprising administering an effective amount of an AAV particle comprising an AAV capsid variant described herein.

In yet another aspect, the present disclosure provides a method of treating a subject having or diagnosed with having a neuro-oncological disorder. The method comprising administering an effective amount of an AAV particle comprising an AAV capsid variant described herein.

Those skilled in the art will recognize or be able to ascertain using no more than routine experimentation, many equivalents to the specific embodiments of the invention described herein. Such equivalents are intended to be encompassed by the following enumerated embodiments.

Enumerated Embodiments

1. An AAV capsid variant, comprising an amino acid sequence having the following formula: [N1]-[N2]-[N3], wherein:
   (i) optionally [N1] comprises X1, X2, and X3, wherein at least one of X1, X2, or X3 is G;
   (ii) [N2] comprises the amino acid sequence of SPH;
   (ii) [N3] comprises X4, X5, and X6, wherein at least one of X4, X5, or X6 is a basic amino acid, e.g., a K or R.
2. The AAV capsid variant of embodiment 1, wherein X4, X5, or both of [N3] is a K.
3. The AAV capsid variant of embodiment 1 or 2, wherein X4, X5, or X6 of [N3] is an R.
4. The AAV capsid variant of any one of embodiments 1-3, wherein:
   (a) position X4 of [N3] is: K, S, A, V, T, G, F, W, V, N, or R;
   (b) position X5 of [N3] is: S, K, T, F, I, L, Y, H, M, or R; and/or
   (c) position X6 of [N3] is: G, A, R, M, I, N, T, Y, D, P, V, L, E, W, N, Q, K, or S;
   optionally wherein the AAV capsid variant comprises an amino acid modification, e.g., a conservative substitution, of any of the aforesaid amino acids in (a)-(c).
5. The AAV capsid variant of any one of embodiments 1-4, wherein [N3] comprises SK, KA, KS, AR, RM, VK, AS, SR, VK, KR, KK, KN, VR, RS, RK, KT, TS, KF, FG, KI, IG, KL, LG, TT, TY, KY, YG, KD, KP, TR, RG, VR, GA, SL, SS, FL, WK, SA, RA, LR, KW, RR, GK, TK, NK, AK, KV, KG, KH, KM, TG, SE, SV, SW, SN, HG, SQ, LW, MG, MA, or SG.
6. The AAV capsid variant of any one of embodiments 1-5, wherein [N3] is or comprises SKA, KSG, ARM, VKS, ASR, VKI, KKN, VRM, RKA, KTS, KFG, KIG, KLG, KTT, KTY, KYG, SKD, SKP, TRG, VRG, KRG, GAR, KSA, KSR, SKL, SRA, SKR, SLR, SRG, SSR, FLR, SKW, SKS, WKA, VRR, SKV, SKT, SKG, GKA, TKA, NKA, SKL, SKN, AKA, KTG, KSL, KSE, KSV, KSW, KSN, KHG, KSQ, KSK, KLW, WKG, KMG, KMA, or RSG.
7. The AAV capsid variant of any one of embodiments 1-6, wherein [N2]-[N3] comprises SPHSK (SEQ ID NO: 4701), SPHKS (SEQ ID NO: 4704), SPHAR (SEQ ID NO: 4705), SPHVK (SEQ ID NO: 4706), SPHAS (SEQ ID NO: 4707), SPHKK (SEQ ID NO: 4708), SPHVR (SEQ ID NO: 4709), SPHRK (SEQ ID NO: 4710), SPHKT (SEQ ID NO: 4711), SPHKF (SEQ ID NO: 4712), SPHKI (SEQ ID NO: 4713), SPHKL (SEQ ID NO: 4714), SPHKY (SEQ ID NO: 4715), SPHTR (SEQ ID NO: 4716), SPHKR (SEQ ID NO: 4717), SPHGA (SEQ ID NO: 4718), SPHSR (SEQ ID NO: 4719), SPHSL (SEQ ID NO: 4720), SPHSS (SEQ ID NO: 4721), SPHFL (SEQ ID NO: 4722), SPHWK (SEQ ID NO: 4723), SPHGK (SEQ ID NO: 4724), SPHTK (SEQ ID NO: 4725), SPHNK (SEQ ID NO: 4726), SPHAK (SEQ ID NO: 4727), SPHKH (SEQ ID NO: 4728), SPHKM (SEQ ID NO: 4729), or SPHRS (SEQ ID NO: 4730).
8. The AAV capsid variant of any one of embodiments 1-7, wherein [N2]-[N3] is or comprises:

(i)
SPHSKA, (SEQ ID NO: 941)

SPHKSG, (SEQ ID NO: 946)

SPHARM, (SEQ ID NO: 947)

SPHVKS, (SEQ ID NO: 948)

SPHASR, (SEQ ID NO: 949)

SPHVKI, (SEQ ID NO: 950)

SPHKKN (SEQ ID NO: 954)

SPHVRM, (SEQ ID NO: 955)

| | |
|---|---|
| SPHRKA, | (SEQ ID NO: 956) |
| SPHKFG, | (SEQ ID NO: 957) |
| SPHKIG, | (SEQ ID NO: 958) |
| SPHKLG, | (SEQ ID NO: 959) |
| SPHKTS, | (SEQ ID NO: 963) |
| SPHKTT, | (SEQ ID NO: 964) |
| SPHKTY, | (SEQ ID NO: 965) |
| SPHKYG, | (SEQ ID NO: 966) |
| SPHSKD, | (SEQ ID NO: 967) |
| SPHSKP, | (SEQ ID NO: 968) |
| SPHTRG, | (SEQ ID NO: 972) |
| SPHVRG, | (SEQ ID NO: 973) |
| SPHKRG, | (SEQ ID NO: 974) |
| SPHGAR, | (SEQ ID NO: 975) |
| SPHKSA, | (SEQ ID NO: 977) |
| SPHKSR, | (SEQ ID NO: 951) |
| SPHSKL, | (SEQ ID NO: 960) |
| SPHSRA, | (SEQ ID NO: 969) |
| SPHSKR, | (SEQ ID NO: 978) |
| SPHSLR, | (SEQ ID NO: 952) |
| SPHSRG, | (SEQ ID NO: 961) |
| SPHSSR, | (SEQ ID NO: 970) |
| SPHFLR, | (SEQ ID NO: 979) |
| SPHSKW, | (SEQ ID NO: 953) |
| SPHSKS, | (SEQ ID NO: 962) |
| SPHWKA, | (SEQ ID NO: 971) |
| SPHVRR, | (SEQ ID NO: 980) |
| SPHSKT, | (SEQ ID NO: 4731) |
| SPHSKG, | (SEQ ID NO: 4732) |
| SPHGKA, | (SEQ ID NO: 4733) |
| SPHNKA, | (SEQ ID NO: 4734) |
| SPHSKN, | (SEQ ID NO: 4735) |
| SPHAKA, | (SEQ ID NO: 4736) |
| SPHSKV, | (SEQ ID NO: 4737) |
| SPHKTG, | (SEQ ID NO: 4738) |
| SPHTKA, | (SEQ ID NO: 4739) |
| SPHKSL, | (SEQ ID NO: 4740) |
| SPHKSE, | (SEQ ID NO: 4741) |
| SPHKSV, | (SEQ ID NO: 4742) |
| SPHKSW, | (SEQ ID NO: 4743) |
| SPHKSN, | (SEQ ID NO: 4744) |
| SPHKHG, | (SEQ ID NO: 4745) |
| SPHKSQ, | (SEQ ID NO: 4746) |
| SPHKSK, | (SEQ ID NO: 4747) |
| SPHKLW, | (SEQ ID NO: 4748) |
| SPHWKG, | (SEQ ID NO: 4749) |
| SPHKMG, | (SEQ ID NO: 4750) |
| SPHKMA, or | (SEQ ID NO: 4751) |
| SPHRSG; | (SEQ ID NO: 976) |

(ii) an amino acid sequence comprising any portion of an amino acid sequence in (i), e.g., any 2, 3, 4, or 5 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

9. The AAV capsid variant of any one of embodiments 1-8, which comprises an amino acid other than G at position 453 (e.g., V, R, D, E, M, T, I, S, A, N, L, K, H, P, W, or C), an amino acid other than S at position 454 (V, L, N, D, H, R, P, G, T, I, A, E, Y, M, or Q), and/or a G at position 455 (e.g., C, L, D, E, Y, H, V, A, N, P, or S), numbered according to any one of SEQ ID NOs: 36-59, 138, 981, 982.

10. The AAV capsid variant of any one of embodiments 1-8, which comprises the amino acid G at position 453, the amino acid S at position 454, and the amino acid G at position 455, numbered according to SEQ ID NO: 138 or 981.

11. The AAV capsid variant of any one of embodiments 1-9, which comprises the amino acid G at position 453, the amino acid H at position 454, and the amino acid D at position 455, numbered according to SEQ ID NO: 138 or 982.

12. The AAV capsid variant of any one of embodiments 1-11, wherein [N1] comprises X1, X2, and X3, wherein at least one of X1, X2, or X3 is G.

13. The AAV capsid variant of any one of embodiments 1-12, wherein:
(a) position X1 of [N1] is: G, V, R, D, E, M, T, I, S, A, N, L, K, H, P, W, or C;
(b) position X2 of [N1] is: S, V, L, N, D, H, R, P, G, T, I, A, E, Y, M, or Q; and/or
(c) position X3 of [N1] is: G, C, L, D, E, Y, H, V, A, N, P, or S;
optionally wherein the AAV capsid variant comprises an amino acid modification, e.g., a conservative substitution, of any of the aforesaid amino acids in (a)-(c).

14. The AAV capsid variant of any one of embodiments 1-13, wherein [N1] comprises GS, SG, GH, HD, GQ, QD, VS, CS, GR, RG, QS, SH, MS, RN, TS, IS, GP, ES, SS, GN, AS, NS, LS, GG, KS, GT, PS, RS, GI, WS, DS, ID, GL, DA, DG, ME, EN, KN, KE, AI, NG, PG, TG, SV, IG, LG, AG, EG, SA, YD, HE, HG, RD, ND, PD, MG, QV, DD, HN, HP, GY, GM, GD, or HS.

15. The AAV capsid variant of any one of embodiments 1-14, wherein [N1] is or comprises GSG, GHD, GQD, VSG, CSG, GRG, CSH, GQS, GSH, RVG, GSC, GLL, GDD, GHE, GNY, MSG, RNG, TSG, ISG, GPG, ESG, SSG, GNG, ASG, NSG, LSG, GGG, KSG, HSG, GTG, PSG, GSV, RSG, GIG, WSG, DSG, IDG, GLG, DAG, DGG, MEG, ENG, GSA, KNG, KEG, AIG, GYD, GHG, GRD, GND, GPD, GMG, GQV, GHN, GHP, or GHS.

16. The AAV capsid variant of any one of embodiments 1-15, wherein [N1]-[N2] comprises:

(i)
SGSPH, (SEQ ID NO: 4752)

HDSPH, (SEQ ID NO: 4703)

QDSPH, (SEQ ID NO: 4753)

RGSPH, (SEQ ID NO: 4754)

SHSPH, (SEQ ID NO: 4755)

QSSPH, (SEQ ID NO: 4756)

DDSPH, (SEQ ID NO: 4757)

HESPH, (SEQ ID NO: 4758)

NYSPH, (SEQ ID NO: 4759)

VGSPH, (SEQ ID NO: 4760)

SCSPH, (SEQ ID NO: 4761)

LLSPH, (SEQ ID NO: 4762)

NGSPH, (SEQ ID NO: 4763)

PGSPH, (SEQ ID NO: 4764)

GGSPH, (SEQ ID NO: 4765)

TGSPH, (SEQ ID NO: 4766)

SVSPH (SEQ ID NO: 4767)

IGSPH, (SEQ ID NO: 4768)

DGSPH, (SEQ ID NO: 4769)

LGSPH, (SEQ ID NO: 4770)

AGSPH, (SEQ ID NO: 4771)

EGSPH, (SEQ ID NO: 4772)

SASPH, (SEQ ID NO: 4773)

YDSPH, (SEQ ID NO: 4774)

HGSPH, (SEQ ID NO: 4775)

RDSPH, (SEQ ID NO: 4776)

NDSPH (SEQ ID NO: 4777)

PDSPH, (SEQ ID NO: 4778)

MGSPH, (SEQ ID NO: 4779)

QVSPH, (SEQ ID NO: 4780)

HNSPH, (SEQ ID NO: 4781)

HPSPH, (SEQ ID NO: 4782)
or

HSSPH; (SEQ ID NO: 4783)

(ii) an amino acid sequence comprising any portion of an amino acid sequence in (i), e.g., any 2, 3, or 4 amino acids, e.g., consecutive amino acids, thereof;
(iii) an amino acid sequence comprising one, two, or three but no more than four modifications, e.g., substitutions (e.g., conservative substitutions), insertions, or deletions, relative to any of the amino acid sequences in (i); or
(iv) an amino acid sequence comprising one, two, or three but no more than four different amino acids, relative to any one of the amino acid sequences in (i).

17. The AAV capsid variant of any one of embodiments 1-16, wherein [N1]-[N2] is or comprises:

(i)
GSGSPH, (SEQ ID NO: 4695)

GHDSPH, (SEQ ID NO: 4784)

GQDSPH, (SEQ ID NO: 4785)

VSGSPH, (SEQ ID NO: 4786)

CSGSPH, (SEQ ID NO: 4787)

GRGSPH, (SEQ ID NO: 4788)

CSHSPH, (SEQ ID NO: 4789)

GQSSPH, (SEQ ID NO: 4790)

GSHSPH, (SEQ ID NO: 4791)

GDDSPH, (SEQ ID NO: 4792)

GHESPH, (SEQ ID NO: 4793)

GNYSPH, (SEQ ID NO: 4794)

RVGSPH, (SEQ ID NO: 4795)

GSCSPH, (SEQ ID NO: 4796)

GLLSPH, (SEQ ID NO: 4797)

MSGSPH, (SEQ ID NO: 4798)

RNGSPH, (SEQ ID NO: 4799)

TSGSPH, (SEQ ID NO: 4800)

ISGSPH, (SEQ ID NO: 4801)

GPGSPH, (SEQ ID NO: 4802)

ESGSPH, (SEQ ID NO: 4803)

-continued

SSGSPH, (SEQ ID NO: 4804)

GNGSPH, (SEQ ID NO: 4805)

ASGSPH, (SEQ ID NO: 4806)

NSGSPH, (SEQ ID NO: 4807)

LSGSPH, (SEQ ID NO: 4808)

GGGSPH, (SEQ ID NO: 4809)

KSGSPH, (SEQ ID NO: 4810)

HSGSPH, (SEQ ID NO: 4811)

GTGSPH, (SEQ ID NO: 4812)

PSGSPH, (SEQ ID NO: 4813)

GSVSPH, (SEQ ID NO: 4814)

RSGSPH, (SEQ ID NO: 4815)

GIGSPH, (SEQ ID NO: 4816)

WSGSPH, (SEQ ID NO: 4817)

DSGSPH, (SEQ ID NO: 4818)

IDGSPH, (SEQ ID NO: 4819)

GLGSPH, (SEQ ID NO: 4820)

DAGSPH, (SEQ ID NO: 4821)

DGGSPH, (SEQ ID NO: 4822)

MEGSPH, (SEQ ID NO: 4823)

ENGSPH, (SEQ ID NO: 4824)

GSASPH, (SEQ ID NO: 4825)

KNGSPH, (SEQ ID NO: 4826)

KEGSPH, (SEQ ID NO: 4827)

AIGSPH, (SEQ ID NO: 4828)

GYDSPH, (SEQ ID NO: 4829)

GHGSPH, (SEQ ID NO: 4830)

GRDSPH, (SEQ ID NO: 4831)

GNDSPH, (SEQ ID NO: 4832)

GPDSPH, (SEQ ID NO: 4833)

GMGSPH, (SEQ ID NO: 4834)

GQVSPH, (SEQ ID NO: 4835)

GHNSPH, (SEQ ID NO: 4836)

GHPSPH, (SEQ ID NO: 4837)
or

GHSSPH; (SEQ ID NO: 4838)

(ii) an amino acid sequence comprising any portion of an amino acid sequence in (i), e.g., any 2, 3, 4, or 5 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

18. The AAV capsid variant of any one of embodiments 1-17, wherein [N1]-[N2]-[N3] comprises:

(i)
SGSPHSK, (SEQ ID NO: 4839)

HDSPHKS, (SEQ ID NO: 4840)

SGSPHAR, (SEQ ID NO: 4841)

SGSPHVK, (SEQ ID NO: 4842)

QDSPHKS, (SEQ ID NO: 4843)

SGSPHKK, (SEQ ID NO: 4844)

SGSPHVR, (SEQ ID NO: 4845)

SGSPHAS, (SEQ ID NO: 4846)

SGSPHRK, (SEQ ID NO: 4847)

SGSPHKT, (SEQ ID NO: 4848)

SHSPHKS, (SEQ ID NO: 4849)

QSSPHRS, (SEQ ID NO: 4850)

RGSPHAS, (SEQ ID NO: 4851)

RGSPHSK, (SEQ ID NO: 4852)

SGSPHKF, (SEQ ID NO: 4853)

SGSPHKI, (SEQ ID NO: 4854)

SGSPHKL, (SEQ ID NO: 4855)

SGSPHKY, (SEQ ID NO: 4856)

SGSPHTR, (SEQ ID NO: 4857)

SHSPHKR, (SEQ ID NO: 4858)

SGSPHGA, (SEQ ID NO: 4859)

HDSPHKR, (SEQ ID NO: 4860)

DDSPHKS, (SEQ ID NO: 4861)

HESPHKS, (SEQ ID NO: 4862)

NYSPHKI, (SEQ ID NO: 4863)

SGSPHSR, (SEQ ID NO: 4864)

SGSPHSL, (SEQ ID NO: 4865)

SGSPHSS, (SEQ ID NO: 4866)

VGSPHSK, (SEQ ID NO: 4867)

SCSPHRK, (SEQ ID NO: 4868)

SGSPHFL, (SEQ ID NO: 4869)

LLSPHWK, (SEQ ID NO: 4870)

NGSPHSK, (SEQ ID NO: 4871)

PGSPHSK, (SEQ ID NO: 4872)

GGSPHSK, (SEQ ID NO: 4873)

TGSPHSK, (SEQ ID NO: 4874)

SVSPHGK, (SEQ ID NO: 4875)

SGSPHTK, (SEQ ID NO: 4876)

IGSPHSK, (SEQ ID NO: 4877)

| | |
|---|---|
| DGSPHSK, | (SEQ ID NO: 4878) |
| SGSPHNK, | (SEQ ID NO: 4879) |
| LGSPHSK, | (SEQ ID NO: 4880) |
| AGSPHSK, | (SEQ ID NO: 4881) |
| EGSPHSK, | (SEQ ID NO: 4882) |
| SASPHSK, | (SEQ ID NO: 4883) |
| SGSPHAK, | (SEQ ID NO: 4884) |
| HDSPHKI, | (SEQ ID NO: 4885) |
| YDSPHKS, | (SEQ ID NO: 4886) |
| HDSPHKT, | (SEQ ID NO: 4887) |
| RGSPHKR, | (SEQ ID NO: 4888) |
| HGSPHSK, | (SEQ ID NO: 4889) |
| RDSPHKS, | (SEQ ID NO: 4890) |
| NDSPHKS, | (SEQ ID NO: 4891) |
| QDSPHKI, | (SEQ ID NO: 4892) |
| PDSPHKI, | (SEQ ID NO: 4893) |
| PDSPHKS, | (SEQ ID NO: 4894) |
| MGSPHSK, | (SEQ ID NO: 4895) |
| HDSPHKH, | (SEQ ID NO: 4896) |
| QVSPHKS, | (SEQ ID NO: 4897) |
| HNSPHKS, | (SEQ ID NO: 4898) |
| NGSPHKR, | (SEQ ID NO: 4899) |
| HDSPHKY, | (SEQ ID NO: 4900) |
| NDSPHKI, | (SEQ ID NO: 4901) |
| HDSPHKL, | (SEQ ID NO: 4902) |
| HPSPHWK, | (SEQ ID NO: 4903) |
| HDSPHKM, | (SEQ ID NO: 4904) | or

| | |
|---|---|
| HSSPHRS; | (SEQ ID NO: 4905) |

(ii) an amino acid sequence comprising any portion of an amino acid sequence in (i), e.g., any 2, 3, 4, 5, or 6 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

19. The AAV capsid variant of any one of embodiments 1-18, wherein [N1]-[N2]-[N3] is or comprises:

(i)

| | |
|---|---|
| GSGSPHSKA, | (SEQ ID NO: 4697) |
| GHDSPHKSG, | (SEQ ID NO: 4698) |
| GSGSPHARM | (SEQ ID NO: 4906) |
| GSGSPHVKS, | (SEQ ID NO: 4907) |
| GQDSPHKSG, | (SEQ ID NO: 4908) |
| GSGSPHASR, | (SEQ ID NO: 4909) |
| GSGSPHVKI, | (SEQ ID NO: 4910) |
| GSGSPHKKN, | (SEQ ID NO: 4911) |
| GSGSPHVRM, | (SEQ ID NO: 4912) |
| VSGSPHSKA, | (SEQ ID NO: 4913) |
| CSGSPHSKA, | (SEQ ID NO: 4914) |
| GSGSPHRKA, | (SEQ ID NO: 4915) |
| CSGSPHKTS, | (SEQ ID NO: 4916) |
| CSHSPHKSG, | (SEQ ID NO: 4917) |
| GQSSPHRSG, | (SEQ ID NO: 4918) |
| GRGSPHASR, | (SEQ ID NO: 4919) |
| GRGSPHSKA, | (SEQ ID NO: 4920) |

-continued

GSGSPHKFG, (SEQ ID NO: 4921)

GSGSPHKIG, (SEQ ID NO: 4922)

GSGSPHKLG, (SEQ ID NO: 4923)

GSGSPHKTS, (SEQ ID NO: 4924)

GSGSPHKTT, (SEQ ID NO: 4925)

GSGSPHKTY, (SEQ ID NO: 4926)

GSGSPHKYG, (SEQ ID NO: 4927)

GSGSPHSKD, (SEQ ID NO: 4928)

GSGSPHSKP, (SEQ ID NO: 4929)

GSGSPHTRG, (SEQ ID NO: 4930)

GSGSPHVRG, (SEQ ID NO: 4931)

GSHSPHKRG, (SEQ ID NO: 4932)

GSHSPHKSG, (SEQ ID NO: 4933)

VSGSPHASR, (SEQ ID NO: 4934)

VSGSPHGAR, (SEQ ID NO: 4935)

VSGSPHKFG, (SEQ ID NO: 4936)

GHDSPHKRG, (SEQ ID NO: 4937)

GDDSPHKSG, (SEQ ID NO: 4938)

GHESPHKSA, (SEQ ID NO: 4939)

GHDSPHKSA, (SEQ ID NO: 4940)

GNYSPHKIG, (SEQ ID NO: 4941)

GHDSPHKSR, (SEQ ID NO: 4942)

GSGSPHSKL, (SEQ ID NO: 4943)

GSGSPHSRA, (SEQ ID NO: 4944)

GSGSPHSKR, (SEQ ID NO: 4945)

GSGSPHSLR, (SEQ ID NO: 4946)

GSGSPHSRG, (SEQ ID NO: 4947)

-continued

GSGSPHSSR, (SEQ ID NO: 4948)

RVGSPHSKA, (SEQ ID NO: 4949)

GSCSPHRKA, (SEQ ID NO: 4950)

GSGSPHFLR, (SEQ ID NO: 4951)

GSGSPHSKW, (SEQ ID NO: 4952)

GSGSPHSKS, (SEQ ID NO: 4953)

GLLSPHWKA, (SEQ ID NO: 4954)

GSGSPHVRR, (SEQ ID NO: 4955)

GSGSPHSKV, (SEQ ID NO: 4956)

MSGSPHSKA, (SEQ ID NO: 4957)

RNGSPHSKA, (SEQ ID NO: 4958)

TSGSPHSKA, (SEQ ID NO: 4959)

ISGSPHSKA, (SEQ ID NO: 4960)

GPGSPHSKA, (SEQ ID NO: 4961)

GSGSPHSKT (SEQ ID NO: 4962)

ESGSPHSKA, (SEQ ID NO: 4963)

SSGSPHSKA, (SEQ ID NO: 4964)

GNGSPHSKA, (SEQ ID NO: 4965)

ASGSPHSKA, (SEQ ID NO: 4966)

NSGSPHSKA, (SEQ ID NO: 4967)

LSGSPHSKA, (SEQ ID NO: 4968)

GGGSPHSKA, (SEQ ID NO: 4969)

KSGSPHSKA (SEQ ID NO: 4970)

GGGSPHSKS, (SEQ ID NO: 4971)

GSGSPHSKG, (SEQ ID NO: 4972)

HSGSPHSKA, (SEQ ID NO: 4973)

GTGSPHSKA, (SEQ ID NO: 4974)

-continued

PSGSPHSKA, (SEQ ID NO: 4975)

GSVSPHGKA, (SEQ ID NO: 4976)

RSGSPHSKA, (SEQ ID NO: 4977)

GSGSPHTKA, (SEQ ID NO: 4978)

GIGSPHSKA, (SEQ ID NO: 4979)

WSGSPHSKA, (SEQ ID NO: 4980)

DSGSPHSKA, (SEQ ID NO: 4981)

IDGSPHSKA, (SEQ ID NO: 4982)

GSGSPHNKA, (SEQ ID NO: 4983)

GLGSPHSKS, (SEQ ID NO: 4984)

DAGSPHSKA, (SEQ ID NO: 4985)

DGGSPHSKA, (SEQ ID NO: 4986)

MEGSPHSKA, (SEQ ID NO: 4987)

ENGSPHSKA, (SEQ ID NO: 4988)

GSASPHSKA, (SEQ ID NO: 4989)

GNGSPHSKS, (SEQ ID NO: 4990)

KNGSPHSKA, (SEQ ID NO: 4991)

KEGSPHSKA, (SEQ ID NO: 4992)

AIGSPHSKA, (SEQ ID NO: 4993)

GSGSPHSKN (SEQ ID NO: 4994)

GSGSPHAKA, (SEQ ID NO: 4995)

GHDSPHKIG, (SEQ ID NO: 4996)

GYDSPHKSG, (SEQ ID NO: 4997)

GHESPHKSG, (SEQ ID NO: 4998)

GHDSPHKTG, (SEQ ID NO: 4999)

GRGSPHKRG, (SEQ ID NO: 5000)

GQDSPHKSG, (SEQ ID NO: 4908)

GHDSPHKSL (SEQ ID NO: 5001)

GHGSPHSKA, (SEQ ID NO: 5002)

GHDSPHKSE, (SEQ ID NO: 5003)

VSGSPHSKA, (SEQ ID NO: 4913)

GRDSPHKSG, (SEQ ID NO: 5004)

GNDSPHKSV, (SEQ ID NO: 5005)

GQDSPHKIG, (SEQ ID NO: 5006)

GHDSPHKSV, (SEQ ID NO: 5007)

GPDSPHKIG, (SEQ ID NO: 5008)

GPDSPHKSG, (SEQ ID NO: 5009)

GHDSPHKSW, (SEQ ID NO: 5010)

GHDSPHKSN, (SEQ ID NO: 5011)

GMGSPHSKT, (SEQ ID NO: 5012)

GHDSPHKHG, (SEQ ID NO: 5013)

GQVSPHKSG, (SEQ ID NO: 5014)

GDDSPHKSV, (SEQ ID NO: 5015)

GHNSPHKSG, (SEQ ID NO: 5016)

GNGSPHKRG, (SEQ ID NO: 5017)

GHDSPHKYG, (SEQ ID NO: 5018)

GHDSPHKSQ, (SEQ ID NO: 5019)

GNDSPHKIG, (SEQ ID NO: 5020)

GHDSPHKSK, (SEQ ID NO: 5021)

GHDSPHKLW, (SEQ ID NO: 5022)

GHPSPHWKG, (SEQ ID NO: 5023)

GHDSPHKMG, (SEQ ID NO: 5024)

GHDSPHKMA, or (SEQ ID NO: 5025)

GHSSPHRSG; (SEQ ID NO: 5026)

(ii) an amino acid sequence comprising any portion of an amino acid sequence in (i), e.g., any 2, 3, 4, 5, 6, 7, or 8 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

20. The AAV capsid variant of any one of embodiments 1-19, wherein [N3] comprises SK, KA, KS, or SG.

21. The AAV capsid variant of any one of embodiments 1-20, wherein [N3] is or comprises SKA, KSG, or KYG.

22. The AAV capsid variant of any one of embodiments 1-21, wherein [N2]-[N3] comprises SPHSK (SEQ ID NO: 4701), SPHKS (SEQ ID NO: 4704), or SPHKY (SEQ ID NO: 4715).

23. The AAV capsid variant of any one of embodiments 1-22, wherein [N2]-[N3] is or comprises SPHSKA (SEQ ID NO: 941).

24. The AAV capsid variant of any one of embodiments 1-22, wherein [N2]-[N3] is or comprises SPHKSG (SEQ ID NO: 946).

25. The AAV capsid variant of any one of embodiments 1-22, wherein [N2]-[N3] is or comprises SPHKYG (SEQ ID NO: 966).

26. The AAV capsid variant of any one of embodiments 1-25, wherein [N1] comprises GS, SG, GH, or HD.

27. The AAV capsid variant of any one of embodiments 1-26, wherein [N1] is or comprises GSG.

28. The AAV capsid variant of any one of embodiments 1-26, wherein [N1] is or comprises GHD.

29. The AAV capsid variant of any one of embodiments 1-23 or 26-27, wherein [N1]-[N2]-[N3] comprises SGSPHSK (SEQ ID NO: 4839).

30. The AAV capsid variant of any one of embodiments 1-22, 24, 26, or 28, wherein [N1]-[N2]-[N3] comprises HDSPHKS (SEQ ID NO: 4840).

31. The AAV capsid variant of any one of embodiments 1-22 or 25-27, wherein [N1]-[N2]-[N3] comprises SGSPHKYG (SEQ ID NO: 5027).

32. The AAV capsid variant of any one of embodiments 1-8, 10, 12-23, 26-27, or 29, wherein [N1]-[N2]-[N3] is or comprises GSGSPHSKA (SEQ ID NO: 4697).

33. The AAV capsid variant of any one of embodiments 1-9, 11-22, 24, 26, 28, or 30, wherein [N1]-[N2]-[N3] is or comprises GHDSPHKSG (SEQ ID NO: 4698).

34. The AAV capsid variant of any one of embodiments 1-8, 10, 12-22, 25-27, or 31, wherein [N1]-[N2]-[N3] is or comprises GSGSPHKYG (SEQ ID NO: 4927).

35. The AAV capsid variant of any one of embodiments 1-34, wherein [N1]-[N2]-[N3] replaces positions 453-455, numbered according to the amino acid sequence of SEQ ID NO: 138.

36. The AAV capsid variant of any one of embodiments 1-35, which comprises an amino acid other than Q at position 456 (e.g., W, K, R, G, L, V, S, P, H, K, I, M, A, E, or F), an amino acid other than N at position 457 (e.g., Y, C, K, T, H, R, D, V, S, P, G, W, E, F, A, I, M, Q, or L), an amino acid other than Q at position 458 (e.g., G, K, H, R, T, L, D, A, P, I, F, V, M, W, Y, S, E, N, or Y), and/or an amino acid other than Q at position 459 (e.g., H, L, R, W, K, A, P, E, M, I, S, G, N, Y, C, V, T, D, or V), relative to a reference sequence numbered according to SEQ ID NO: 138.

37. The AAV capsid variant of any one of embodiments 1-36, which comprises an amino acid other than Q at position 462 (e.g., W, K, R, G, L, V, S, P, H, K, I, M, A, E, or F), an amino acid other than N at position 463 (e.g., Y, C, K, T, H, R, D, V, S, P, G, W, E, F, A, I, M, Q, or L), an amino acid other than Q at position 464 (e.g., G, K, H, R, T, L, D, A, P, I, F, V, M, W, Y, S, E, N, or Y), and/or an amino acid other than Q at position 465 (e.g., H, L, R, W, K, A, P, E, M, I, S, G, N, Y, C, V, T, D, or V), relative to a reference sequence numbered according to SEQ ID NO: 981, 982, 36, 37, 39, 40, 42-46, 48, 49, 50, 52, 53, 56, or 57.

38. The AAV capsid variant of any one of embodiments 1-37, which comprises:

(a) the amino acid Q at position 456, the amino acid N at position 457, the amino acid Q at position 458, and/or the amino acid Q at position 459, relative to a reference sequence numbered according to SEQ ID NO: 138; or (b) the amino acid Q at position 462, the amino acid N at position 463, the amino acid Q at position 464, and/or the amino acid Q at position 465, relative to a reference sequence numbered according to SEQ ID NO: 981, 982, 36, 37, 39, 40, 42-46, 48, 49, 50, 52, 53, 56, or 57.

39. The AAV capsid variant of any one of embodiments 1-38, which further comprises [N4], wherein [N4] comprises X7 X8 X9 X10, and wherein:

(a) position X7 is: Q, W, K, R, G, L, V, S, P, H, K, I, M, A, E, or F;

(b) position X8 is: N, Y, C, K, T, H, R, D, V, S, P, G, W, E, F, A, I, M, Q, or L;

(c) position X9 is: Q, G, K, H, R, T, L, D, A, P, I, F, V, M, W, Y, S, E, N, or Y; and (d) position X10 is: Q, H, L, R, W, K, A, P, E, M, I, S, G, N, Y, C, V, T, D, or V; optionally wherein the AAV capsid variant comprises an amino acid modification, e.g., a conservative substitution, of any of the aforesaid amino acids in (a)-(d).

40. The AAV capsid variant of embodiment 39, wherein:

(a) position X7 of [N4] is Q or R;

(b) position X8 of [N4] is N or R;

(c) position X9 of [N4] is Q or R; and (d) position X10 of [N4] is Q, L, or R.

41. The AAV capsid variant of embodiment 39 or 40, wherein [N4] is or comprises:

(i)

QNQQ, (SEQ ID NO: 5028)

WNQQ, (SEQ ID NO: 5029)

QYYV, (SEQ ID NO: 5030)

RRQQ, (SEQ ID NO: 5031)

GCGQ, (SEQ ID NO: 5032)

LRQQ, (SEQ ID NO: 5033)

-continued

RNQQ, (SEQ ID NO: 5034)

VNQQ, (SEQ ID NO: 5035)

FRLQ, (SEQ ID NO: 5036)

FNQQ, (SEQ ID NO: 5037)

LLQQ, (SEQ ID NO: 5038)

SNQQ, (SEQ ID NO: 5039)

RLQQ, (SEQ ID NO: 5040)

LNQQ, (SEQ ID NO: 5041)

QRKL, (SEQ ID NO: 5042)

LRRQ, (SEQ ID NO: 5043)

QRLR, (SEQ ID NO: 5044)

QRRL, (SEQ ID NO: 5045)

RRLQ, (SEQ ID NO: 5046)

RLRQ, (SEQ ID NO: 5047)

SKRQ, (SEQ ID NO: 5048)

QLYR, (SEQ ID NO: 5049)

QLTV, (SEQ ID NO: 5050)

QNKQ, (SEQ ID NO: 5051)

KNQQ, (SEQ ID NO: 5052)

QKQQ, (SEQ ID NO: 5053)

QTQQ, (SEQ ID NO: 5054)

QNHQ, (SEQ ID NO: 5055)

QHQQ, (SEQ ID NO: 5056)

QNQH, (SEQ ID NO: 5057)

QHRQ, (SEQ ID NO: 5058)

LTQQ, (SEQ ID NO: 5059)

QNQW, (SEQ ID NO: 5060)

QNTH, (SEQ ID NO: 5061)

RRRQ, (SEQ ID NO: 5062)

QYQQ, (SEQ ID NO: 5063)

QNDQ, (SEQ ID NO: 5064)

QNRH, (SEQ ID NO: 5065)

RDQQ, (SEQ ID NO: 5066)

PNLQ, (SEQ ID NO: 5067)

HVRQ, (SEQ ID NO: 5068)

PNQH, (SEQ ID NO: 5069)

HNQQ, (SEQ ID NO: 5070)

QSQQ, (SEQ ID NO: 5071)

QPAK, (SEQ ID NO: 5072)

QNLA, (SEQ ID NO: 5073)

QNQL, (SEQ ID NO: 5074)

QGQQ, (SEQ ID NO: 5075)

LNRQ, (SEQ ID NO: 5076)

QNPP, (SEQ ID NO: 5077)

QNLQ, (SEQ ID NO: 5078)

QDQE, (SEQ ID NO: 5079)

QDQQ, (SEQ ID NO: 5080)

HWQQ, (SEQ ID NO: 5081)

PNQQ, (SEQ ID NO: 5082)

PEQQ, (SEQ ID NO: 5083)

QRTM, (SEQ ID NO: 5084)

LHQH, (SEQ ID NO: 5085)

QHRI, (SEQ ID NO: 5086)

QYIH, (SEQ ID NO: 5087)

QKFE, (SEQ ID NO: 5088)

QFPS, (SEQ ID NO: 5089)

QNPL, (SEQ ID NO: 5090)

QAIK, (SEQ ID NO: 5091)

QNRQ, (SEQ ID NO: 5092)

QYQH, (SEQ ID NO: 5093)

QNPQ, (SEQ ID NO: 5094)

QHQL, (SEQ ID NO: 5095)

QSPP, (SEQ ID NO: 5096)

QAKL, (SEQ ID NO: 5097)

KSQQ, (SEQ ID NO: 5098)

QDRP, (SEQ ID NO: 5099)

QNLG, (SEQ ID NO: 5100)

QAFH, (SEQ ID NO: 5101)

QNAQ, (SEQ ID NO: 5102)

HNQL, (SEQ ID NO: 5103)

QKLN, (SEQ ID NO: 5104)

QNVQ, (SEQ ID NO: 5105)

QAQQ, (SEQ ID NO: 5106)

QTPP, (SEQ ID NO: 5107)

QPPA, (SEQ ID NO: 5108)

QERP, (SEQ ID NO: 5109)

QDLQ, (SEQ ID NO: 5110)

QAMH, (SEQ ID NO: 5111)

QHPS, (SEQ ID NO: 5112)

PGLQ, (SEQ ID NO: 5113)

QGIR, (SEQ ID NO: 5114)

QAPA, (SEQ ID NO: 5115)

QIPP, (SEQ ID NO: 5116)

QTQL, (SEQ ID NO: 5117)

QAPS, (SEQ ID NO: 5118)

QNTY, (SEQ ID NO: 5119)

QDKQ, (SEQ ID NO: 5120)

QNHL, (SEQ ID NO: 5121)

QIGM, (SEQ ID NO: 5122)

LNKQ, (SEQ ID NO: 5123)

PNQL, (SEQ ID NO: 5124)

QLQQ, (SEQ ID NO: 5125)

QRMS, (SEQ ID NO: 5126)

QGIL, (SEQ ID NO: 5127)

QDRQ, (SEQ ID NO: 5128)

RDWQ, (SEQ ID NO: 5129)

QERS, (SEQ ID NO: 5130)

QNYQ, (SEQ ID NO: 5131)

QRTC, (SEQ ID NO: 5132)

QIGH, (SEQ ID NO: 5133)

QGAI, (SEQ ID NO: 5134)

QVPP, (SEQ ID NO: 5135)

QVQQ, (SEQ ID NO: 5136)

LMRQ, (SEQ ID NO: 5137)

QYSV, (SEQ ID NO: 5138)

QAIT, (SEQ ID NO: 5139)

QKTL, (SEQ ID NO: 5140)

QLHH, (SEQ ID NO: 5141)

-continued

QNII, (SEQ ID NO: 5142)

QGHH, (SEQ ID NO: 5143)

QSKV, (SEQ ID NO: 5144)

QLPS, (SEQ ID NO: 5145)

IGKQ, (SEQ ID NO: 5146)

QAIH, (SEQ ID NO: 5147)

QHGL, (SEQ ID NO: 5148)

QFMC, (SEQ ID NO: 5149)

QNQM, (SEQ ID NO: 5150)

QHLQ, (SEQ ID NO: 5151)

QPAR, (SEQ ID NO: 5152)

QSLQ, (SEQ ID NO: 5153)

QSQL, (SEQ ID NO: 5154)

HSQQ, (SEQ ID NO: 5155)

QMPS, (SEQ ID NO: 5156)

QGSL, (SEQ ID NO: 5157)

QVPA, (SEQ ID NO: 5158)

HYQQ, (SEQ ID NO: 5159)

QVPS, (SEQ ID NO: 5160)

RGEQ, (SEQ ID NO: 5161)

PGQQ, (SEQ ID NO: 5162)

LEQQ, (SEQ ID NO: 5163)

QNQS, (SEQ ID NO: 5164)

QKVI, (SEQ ID NO: 5165)

QNND, (SEQ ID NO: 5166)

QSVH, (SEQ ID NO: 5167)

QPLG, (SEQ ID NO: 5168)

-continued

HNQE, (SEQ ID NO: 5169)

QIQQ, (SEQ ID NO: 5170)

QVRN, (SEQ ID NO: 5171)

PSNQ, (SEQ ID NO: 5172)

QVGH, (SEQ ID NO: 5173)

QRDI, (SEQ ID NO: 5174)

QMPN, (SEQ ID NO: 5175)

RGLQ, (SEQ ID NO: 5176)

PSLQ, (SEQ ID NO: 5177)

QRDQ, (SEQ ID NO: 5178)

QAKG, (SEQ ID NO: 5179)

QSAH, (SEQ ID NO: 5180)

QSTM, (SEQ ID NO: 5181)

QREM, (SEQ ID NO: 5182)

QYRA, (SEQ ID NO: 5183)

QRQQ, (SEQ ID NO: 5184)

QWQQ, (SEQ ID NO: 5185)

QRMN, (SEQ ID NO: 5186)

GDSQ, (SEQ ID NO: 5187)

QKIS, (SEQ ID NO: 5188)

PSMQ, (SEQ ID NO: 5189)

SPRQ, (SEQ ID NO: 5190)

MEQQ, (SEQ ID NO: 5191)

QYQN, (SEQ ID NO: 5192)

QIRQ, (SEQ ID NO: 5193)

QSVQ, (SEQ ID NO: 5194)

RSQQ, (SEQ ID NO: 5195)

QNKL, (SEQ ID NO: 5196)

QIQH, (SEQ ID NO: 5197)

PRQQ, (SEQ ID NO: 5198)

HTQQ, (SEQ ID NO: 5199)

QRQH, (SEQ ID NO: 5200)

RNQE, (SEQ ID NO: 5201)

QSKQ, (SEQ ID NO: 5202)

QNQP, (SEQ ID NO: 5203)

QSPQ, (SEQ ID NO: 5204)

QTRQ, (SEQ ID NO: 5205)

QNLH, (SEQ ID NO: 5206)

QNQE, (SEQ ID NO: 5207)

LNQP, (SEQ ID NO: 5208)

QNQD, (SEQ ID NO: 5209)

QNLL, (SEQ ID NO: 5210)

QLVI, (SEQ ID NO: 5211)

RTQE, (SEQ ID NO: 5212)

QTHQ, (SEQ ID NO: 5213)

QDQH, (SEQ ID NO: 5214)

QSQH, (SEQ ID NO: 5215)

VRQQ, (SEQ ID NO: 5216)

AWQQ, (SEQ ID NO: 5217)

QSVP, (SEQ ID NO: 5218)

QNIQ, (SEQ ID NO: 5219)

LDQQ, (SEQ ID NO: 5220)

PDQQ, (SEQ ID NO: 5221)

ESQQ, (SEQ ID NO: 5222)

QRQL, (SEQ ID NO: 5223)

QIIV, (SEQ ID NO: 5224)

QKQS, (SEQ ID NO: 5225)

QSHQ, (SEQ ID NO: 5226)

QFVV, (SEQ ID NO: 5227)

QSQP, (SEQ ID NO: 5228)

QNEQ, (SEQ ID NO: 5229)

INQQ, (SEQ ID NO: 5230)

RNRQ, (SEQ ID NO: 5231)

RDQK, (SEQ ID NO: 5232)

QWKR, (SEQ ID NO: 5233)

ENRQ, (SEQ ID NO: 5234)

QTQP, (SEQ ID NO: 5235)

QKQL, (SEQ ID NO: 5236)

RNQL, (SEQ ID NO: 5237)

ISIQ, (SEQ ID NO: 5238)

QTVC, (SEQ ID NO: 5239)

QQIM, (SEQ ID NO: 5240)

LNHQ, (SEQ ID NO: 5241)

QNQA, (SEQ ID NO: 5242)

QMIH, (SEQ ID NO: 5243)

RNHQ, (SEQ ID NO: 5244)
or

QKMN; (SEQ ID NO: 5245)

(ii) an amino acid sequence comprising any portion of an amino acid sequence in (i), e.g., any 2, or 3 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

42. The AAV capsid variant of any one of embodiments 39-41, wherein [N1]-[N2]-[N3]-[N4] is or comprises:
    (i) the amino acid sequence of any of SEQ ID NOs: 1800-2241;
    (ii) an amino acid sequence comprising any portion of an amino acid sequence in (i), e.g., any 2, 3, 4, 5, 6, 7, 8, 9, 10, 11, or 12 amino acids, e.g., consecutive amino acids, thereof;
    (iii) an amino acid sequence comprising one, two, or three but no more than four modifications, e.g., substitutions (e.g., conservative substitutions), insertions, or deletions, relative to any of the amino acid sequences in (i); or
    (iv) an amino acid sequence comprising one, two, or three but no more than four different amino acids, relative to any one of the amino acid sequences in (i).

43. The AAV capsid variant of any one of embodiments 39-42, wherein [N1]-[N2]-[N3]-[N4] is or comprises GSGSPHSKAQNQQ (SEQ ID NO: 1801).

44. The AAV capsid variant of any one of embodiments 39-42, wherein [N1]-[N2]-[N3]-[N4] is or comprises GHDSPHKSGQNQQ (SEQ ID NO: 1800).

45. The AAV capsid variant of any one of embodiments 39-42, wherein [N1]-[N2]-[N3]-[N4] is or comprises GSGSPHKYGQNQQT (SEQ ID NO: 910).

46. The AAV capsid variant of any one of embodiments 1-45, which comprises an amino acid other than T at position 450 (e.g., S, Y, M, A, C, I, R, L, D, F, V, Q, N, H, E, or G), an amino acid other than I at position 451 (e.g., M, P, E, N, D, S, A, T, G, Q, F, V, L, C, H, R, W, or L), and/or an amino acid other than N at position 452 (e.g., M, E, G, Y, W, T, I, Q, F, V, A, L, I, P, K, R, H, S, D, or S), relative to a reference sequence numbered according to any one of SEQ ID NOs: 36-59, 138, 981, or 982.

47. The AAV capsid variant of any one of embodiments 1-46, which comprises the amino acid T at position 450, the amino acid I at position 451, and/or the amino acid N at position 452, relative to a reference sequence numbered according to any one of SEQ ID NOs: 138, 981, or 982.

48. The AAV capsid variant of any one of embodiments 1-47, which further comprises [N0], wherein [N0] comprises XA XB and XC, and wherein:
    (a) position XA is: T, S, Y, M, A, C, I, R, L, D, F, V, Q, N, H, E, or G;
    (b) position XB is: I, M, P, E, N, D, S, A, T, G, Q, F, V, L, C, H, R, W, or L; and
    (c) position XC is: N, M, E, G, Y, W, T, I, Q, F, V, A, L, I, P, K, R, H, S, D, or S; and
    optionally wherein the AAV capsid variant comprises an amino acid modification, e.g., a conservative substitution, of any of the aforesaid amino acids in (a)-(c).

49. The AAV capsid variant of embodiment 48, wherein [N0] is or comprises TIN, SMN, TIM, YLS, GLS, MPE, MEG, MEY, AEW, CEW, ANN, IPE, ADM, IEY, ADY, IET, MEW, CEY, RIN, MEI, LEY, ADW, IEI, DIM, FEQ, MEF, CDQ, LPE, IEN, MES, AEI, VEY, IIN, TSN, IEV, MEM, AEV, MDA, VEW, AEQ, LEW, MEL, MET, MEA, IES, MEV, CEI, ATN, MDG, QEV, ADQ, NMN, IEM, ISN, TGN, QQQ, HDW, IEG, TII, TFP, TEK, EIN, TVN, TFN, SIN, TER, TSY, ELH, AIN, SVN, TDN, TFH, TVH, TEN, TSS, TID, TCN, NIN, TEH, AEM, AIK, TDK, TFK, SDQ, TEI, NTN, TET, SIK, TEL, TEA, TAN, TIY, TFS, TES, TTN, TED, TNN, EVH, TIS, TVR, TDR, TIK, NHI, TIP, ESD, TDL, TVP, TVI, AEH, NCL, TVK, NAD, TIT, NCV, TIR, NAL, VIN, TIQ, TEF, TRE, QGE, SEK, NVN, GGE, EFV, SDK, TEQ, EVQ, TEY, NCW, TDV, SDI, NSI, NSL, EVV, TEP, SEL, TWQ, TEV, AVN, GVL, TLN, TEG, TRD, NAI, AEN, AET, ETA, NNL, or any dipeptide thereof.

50. The AAV capsid variant of embodiment 48 or 49, wherein [N0]-[N1]-[N2]-[N3]-[N4] is or comprises:
    (i) the amino acid sequence of any one of SEQ ID NOs: 2242-2886;
    (ii) an amino acid sequence comprising any portion of an amino acid sequence in (i), e.g., any 2, 3, 4, 5, 6, 7, 8, 9, 10, 11, 12, 13, 14, or 15 amino acids, e.g., consecutive amino acids, thereof;
    (iii) an amino acid sequence comprising one, two, or three but no more than four modifications, e.g., substitutions (e.g., conservative substitutions), insertions, or deletions, relative to any of the amino acid sequences in (i); or
    (iv) an amino acid sequence comprising one, two, or three but no more than four different amino acids, relative to any one of the amino acid sequences in (i).

51. The AAV capsid variant of any one of embodiments 48-50, wherein [N0]-[N1]-[N2]-[N3]-[N4] is or comprises TINGSGSPHSKAQNQQ (SEQ ID NO: 2242).

52. The AAV capsid variant of any one of embodiments 48-50, wherein [N0]-[N1]-[N2]-[N3]-[N4] is or comprises TINGHDSPHKSGQNQQ (SEQ ID NO: 2243).

53. The AAV capsid variant of any one of embodiments 48-52, wherein [N0]-[N1]-[N2]-[N3]-[N4] is or comprises TINGSGSPHKYGQNQQT (SEQ ID NO: 5246).

54. The AAV capsid variant of any one of embodiments 1-53, wherein [N1]-[N2]-[N3] is present in loop IV.

55. The AAV capsid variant of any one of embodiments 48-54, wherein [N0] and [N4] are present in loop IV.

56. The AAV capsid variant of any one of embodiments 48-55, wherein [N0] is present immediately subsequent to position 449, relative to a reference sequence numbered according to the amino acid sequence of SEQ ID NO: 138.

57. The AAV capsid variant of any one of embodiments 48-56, wherein [N0] is present immediately subsequent to position 449, relative to a reference sequence numbered according to the amino acid sequence of any one of SEQ ID NOs: 36-59, 981, or 982.

58. The AAV capsid variant of any one of embodiments 48-57, wherein [N0] replaces positions 450, 451, and 452 (e.g., T450, I451, and N452), relative to a reference sequence numbered according to SEQ ID NO: 138.

59. The AAV capsid variant of any one of embodiments 48-58, wherein [N0] replaces positions 450-452 (e.g., T450, I451, and N452), relative to a reference sequence numbered according to any one of SEQ ID NOs: 36-59, 981, or 982.

60. The AAV capsid variant of any one of embodiments 48-59, wherein [N0] corresponds to positions 450-452 of any one of SEQ ID NOs: 36-59, 138, 981 or 982.

61. The AAV capsid variant of any one of embodiments 48-60, wherein [N0] is present immediately subsequent to position 449 and wherein [N0] replaces positions 450-452 (e.g., T450, I451, and N452), relative to a reference sequence numbered according to SEQ ID NO: 138.
62. The AAV capsid variant of any one of embodiments 48-61, wherein [N0] is present immediately subsequent to position 449 and wherein [N0] replaces positions 450-452 (e.g., T450, I451, and N452), relative to a reference sequence numbered according to any one of SEQ ID NOs: 36-59, 981, or 982.
63. The AAV capsid variant of any one of embodiments 1-62, wherein [N1] is present immediately subsequent to position 452, relative to a reference sequence numbered according to the amino acid sequence of SEQ ID NO: 138.
64. The AAV capsid variant of any one of embodiments 1-63, wherein [N1] is present immediately subsequent to position 452, relative to a reference sequence numbered according to the amino acid sequence of SEQ ID NO: 981 or 982.
65. The AAV capsid variant of any one of embodiments 1-61, wherein [N1] replaces positions 453-455 (e.g., G453, S454, and G455), relative to a reference sequence numbered according to SEQ ID NO: 138.
66. The AAV capsid variant of any one of embodiments 1-64, wherein [N1] replaces positions 453 (e.g., G453), relative to a reference sequence numbered according to SEQ ID NO: 138.
67. The AAV capsid variant of any one of embodiments 1-65, wherein [N1] replaces positions 453-455 (e.g., G453, S454, and G455), relative to a reference sequence numbered according to SEQ ID NO: 981.
68. The AAV capsid variant of any one of embodiments 1-65 or 67, wherein [N1] replaces positions 453-455, relative to a reference sequence numbered according to SEQ ID NO: 982.
69. The AAV capsid variant of any one of embodiments 1-65, 67, or 68, wherein [N1] is present immediately subsequent to position 452 and wherein [N1] replaces positions 453-455 (e.g., G453, S454, and G455), relative to a reference sequence numbered according to SEQ ID NO: 138.
70. The AAV capsid variant of any one of embodiments 1-64 or 66, wherein [N1] is present immediately subsequent to position 452 and wherein [N1] replaces positions 453 (e.g., G453), relative to a reference sequence numbered according to SEQ ID NO: 138.
71. The AAV capsid variant of any one of embodiments 1-64, 66 or 70, wherein [N1] is present immediately subsequent to position 452 and wherein [N1] replaces positions 453-455, relative to a reference sequence numbered according to SEQ ID NO: 981 or 982.
72. The AAV capsid variant of any one of embodiments 1-71, wherein [N1] corresponds to positions 453-455 of any one of SEQ ID NOs: 36-59, 981 or 982.
73. The AAV capsid variant of any one of embodiment 1-72, which comprises an amino acid other than S at position 454 and/or an amino acid other than G at position 455, numbered according to SEQ ID NO: 138, 981, or 982.
74. The AAV capsid variant of any one of embodiments 1-73, which comprises the amino acid H at position 454 and the amino acid D at position 455, numbered according to SEQ ID NO: 138 or 982.
75. The AAV capsid variant of any one of embodiments 1-74, which comprises a substitution at position 454 (e.g., S454H) and/or a substitution at position 455 (e.g., G455D), numbered according to SEQ ID NO: 138.
76. The AAV capsid variant of any one of embodiments 1-75, which comprises the amino acid H at position 454 and the amino acid D at position 455, and further comprises the amino acid sequence SPHSKA (SEQ ID NO: 941) immediately subsequent to position 455, relative to a reference sequence numbered according to SEQ ID NO: 138.
77. The AAV capsid variant of any one of embodiments 1-76, which comprises the amino acid H at position 454 and the amino acid D at position 455, relative to a reference sequence numbered according to SEQ ID NO: 982.
78. The AAV capsid variant of any one of embodiments 1-77, which comprises the amino acid H at position 454 and the amino acid D at position 455, and further comprises the amino acid sequence SPHSKA (SEQ ID NO: 941) immediately subsequent to position 455, relative to a reference sequence numbered according to SEQ ID NO: 982.
79. The AAV capsid variant of any one of embodiments 1-72, which comprises the amino acid S at position 454 and the amino acid G at position 455, relative to a reference sequence numbered according to SEQ ID NO: 138.
80. The AAV capsid variant of any one of embodiments 1-72 or 79, which comprises the amino acid S at position 454 and the amino acid G at position 455, and further comprises the amino acid sequence SPHSKA (SEQ ID NO: 941) immediately subsequent to position 455, relative to a reference sequence numbered according to SEQ ID NO: 138.
81. The AAV capsid variant of any one of embodiments 1-72, 79, or 80, which comprises the amino acid S at position 454 and the amino acid G at position 455, relative to a reference sequence numbered according to SEQ ID NO: 981.
82. The AAV capsid variant of any one of embodiments 1-72 or 79-81, which comprises the amino acid S at position 454 and the amino acid G at position 455, and further comprises the amino acid sequence SPHSKA (SEQ ID NO: 941) immediately subsequent to position 455, relative to a reference sequence numbered according to SEQ ID NO: 981.
83. The AAV capsid variant of any one of embodiments 1-82, wherein [N2] is present immediately subsequent to position 455, relative to a reference sequence numbered according to the amino acid sequence of SEQ ID NO: 138.
84. The AAV capsid variant of any one of embodiments 1-83, wherein [N2] corresponds to positions 456-458 (e.g., S456, P457, H458) of SEQ ID NO: 981 or 982.
85. The AAV capsid variant of any one of embodiments 1-83, wherein [N2] corresponds to positions 456-458 (e.g., S456, P457, H458) of any one of SEQ ID NOs: 36-59.
86. The AAV capsid variant of any one of embodiments 1-85, wherein [N2]-[N3] is present immediately subsequent to position 455, relative to a reference sequence numbered according to the amino acid sequence of SEQ ID NO: 138.
87. The AAV capsid variant of any one of embodiments 1-86, wherein [N2] is present immediately subsequent to position 455, relative to a reference sequence numbered according to the amino acid sequence of SEQ ID NO: 981 or 982.
88. The AAV capsid variant of any one of embodiments 1-87, wherein [N2]-[N3] is present immediately subsequent to position 455, relative to a reference sequence numbered according to the amino acid sequence of SEQ ID NO: 981 or 982.

89. The AAV capsid variant of any one of embodiments 1-88, wherein [N2]-[N3] corresponds to positions 456-461 (e.g., S456, P457, H458, S459, K460, A461) of SEQ ID NO: 981.

90. The AAV capsid variant of any one of embodiments 1-88, wherein [N2]-[N3] corresponds to positions 456-461 (e.g., S456, P457, H458, K459, S460, G461) of SEQ ID NO: 982.

91. The AAV capsid variant of any one of embodiments 1-90, wherein [N2] is present immediately subsequent to [N1].

92. The AAV capsid variant of any one of embodiments 1-64, 66, 70, or 71, wherein [N3] is present immediately subsequent to [N2] and replaces positions 454 and 455 (e.g., S454 and G455), numbered according to SEQ ID NO: 138.

93. The AAV capsid variant of any one of embodiments 1-1-64, 66, 70, 71, or 92, wherein [N3] is present immediately subsequent to [N1]-[N2] and replaces positions 454 and 455 (e.g., S454 and G455), numbered according to SEQ ID NO: 138.

94. The AAV capsid variant of any one of embodiments 39-93, wherein [N4] is present immediately subsequent to position 455, relative to a reference sequence numbered according to the amino acid sequence of SEQ ID NO: 138.

95. The AAV capsid variant of any one of embodiments 39-94, wherein [N4] replaces positions 456-459 (e.g., Q456, N457, Q458, and Q459), relative to a reference sequence numbered according to the amino acid sequence of SEQ ID NO: 138.

96. The AAV capsid variant of any one of embodiments 39-95, wherein [N4] corresponds to positions 462-465 (e.g., Q462, N463, Q464, Q465) of SEQ ID NO: 981 or 982.

97. The AAV capsid variant of any one of embodiments 39-96, wherein [N2]-[N3]-[N4] replaces positions 456-459 (e.g., Q456, N457, Q458, and Q459), relative to a reference sequence numbered according to the amino acid sequence of SEQ ID NO: 138.

98. The AAV capsid variant of any one of embodiments 39-97, wherein [N2]-[N3]-[N4] is present immediately subsequent to position 455, and wherein [N2]-[N3]-[N4] replaces positions 456-459 (e.g., Q456, N457, Q458, and Q459), relative to a reference sequence numbered according to the amino acid sequence of SEQ ID NO: 138.

99. The AAV capsid variant of any one of embodiments 39-98, wherein [N2]-[N3]-[N4] corresponds to positions 456-465 (e.g., S456, P457, H458, S459, K460, A461, Q462, N463, Q464, Q465) of SEQ ID NO: 981.

100. The AAV capsid variant of any one of embodiments 39-98, wherein [N2]-[N3]-[N4] corresponds to positions 456-465 (e.g., S456, P457, H458, K459, S460, G461, Q462, N463, Q464, Q465) of SEQ ID NO: 982.

101. The AAV capsid variant of any one of embodiments 39-98, wherein [N2]-[N3]-[N4] corresponds to positions 456-465 of any one of SEQ ID NOs: 36-59.

102. The AAV capsid variant of any one of embodiments 39-101, wherein [N1]-[N2]-[N3]-[N4] replaces positions 453-459 (e.g., G453, S454, G455, Q456, N457, Q458, and Q459), relative to a reference sequence numbered according to the amino acid sequence of SEQ ID NO: 138.

103. The AAV capsid variant of any one of embodiments 39-102, wherein [N1]-[N2]-[N3]-[N4] is present immediately subsequent to position 452, and wherein [N1]-[N2]-[N3]-[N4] replaces positions 453-459 (e.g., G453, S454, G455, Q456, N457, Q458, and Q459), relative to a reference sequence numbered according to the amino acid sequence of SEQ ID NO: 138.

104. The AAV capsid variant of any one of embodiments 39-99, 102, 103, wherein [N1]-[N2]-[N3]-[N4] corresponds to positions 453-465 (e.g., G453, S454, G455, S456, P457, H458, S459, K460, A461, Q462, N463, Q464, Q465) of SEQ ID NO: 981.

105. The AAV capsid variant of any one of embodiments 39-98, 100, 102, or 103, wherein [N1]-[N2]-[N3]-[N4] corresponds to positions 453-465 (e.g., G453, H454, D455, S456, P457, H458, K459, S460, G461, Q462, N463, Q464, Q465) of SEQ ID NO: 982.

106. The AAV capsid variant of any one of embodiments 39-98, 102, or 103, wherein [N1]-[N2]-[N3]-[N4] corresponds to positions 453-465 of any one of SEQ ID NOs: 36-59.

107. The AAV capsid variant of any one of embodiments 1-99 or 102-104, wherein [N1]-[N2]-[N3] corresponds to positions 453-461 (e.g., G453, S454, G455, S456, P457, H458, S459, K460, A461) of SEQ ID NO: 981.

108. The AAV capsid variant of any one of embodiments 1-98, 100, 102, 103, or 105, wherein [N1]-[N2]-[N3] corresponds to positions 453-461 (e.g., G453, H454, D455, S456, P457, H458, K459, S460, G461) of SEQ ID NO: 982.

109. The AAV capsid variant of any one of embodiments 39-98, 102, 103, or 106, wherein [N1]-[N2]-[N3] corresponds to positions 453-461 of any one of SEQ ID NOs: 36-59.

110. The AAV capsid variant of any one of embodiments 48-109, wherein [N0]-[N1]-[N2]-[N3]-[N4] replaces positions 450-459 (e.g., T450, I451, N452, G453, S454, G455, Q456, N457, Q458, and Q459), relative to a reference sequence numbered according to the amino acid sequence of SEQ ID NO: 138.

111. The AAV capsid variant of any one of embodiments 48-110, wherein [N0]-[N1]-[N2]-[N3]-[N4] is present immediately subsequent to position 449, and wherein [N0]-[N1]-[N2]-[N3]-[N4] replaces positions 450-459 (e.g., T450, I451, N452, G453, S454, G455, Q456, N457, Q458, and Q459), relative to a reference sequence numbered according to the amino acid sequence of SEQ ID NO: 138.

112. The AAV capsid variant of any one of embodiments 48-99, 102-104, or 106, wherein [N0]-[N1]-[N2]-[N3]-[N4] corresponds to positions 450-465 (e.g., T450, I451, N452, G453, S454, G455, S456, P457, H458, S459, K460, A461, Q462, N463, Q464, Q465) of SEQ ID NO: 981.

113. The AAV capsid variant of any one of embodiments 48-98, 100, 102, 103, 105, or 108, wherein [N0]-[N1]-[N2]-[N3]-[N4] corresponds to positions 450-465 (e.g., T450, I451, N452, G453, H454, D455, S456, P457, H458, K459, S460, G461, Q462, N463, Q464, Q465) of SEQ ID NO: 982.

114. The AAV capsid variant of any one of embodiments 48-98, 102, 103, 106, or 109, wherein [N0]-[N1]-[N2]-[N3]-[N4] corresponds to positions 450-465 of any one of SEQ ID NOs: 36-59.

115. The AAV capsid variant of any one of embodiments 39-114, wherein [N4] replaces positions 462-465 (e.g., Q462, N463, Q464, and Q465), relative to a reference sequence numbered according to the amino acid sequence of SEQ ID NO: 981 or 982.

116. The AAV capsid variant of any one of embodiments 39-115, wherein [N2]-[N3]-[N4] replaces positions 462-465 (e.g., Q462, N463, Q464, and Q465), relative to a reference sequence numbered according to the amino acid sequence of SEQ ID NO: 981 or 982.

117. The AAV capsid variant of any one of embodiments 39-116, wherein [N2]-[N3]-[N4] is present immediately subsequent to position 455, and wherein [N2]-[N3]-[N4] replaces positions 462-465 (e.g., Q462, N463, Q464, and Q465), relative to a reference sequence numbered according to the amino acid sequence of SEQ ID NO: 981 or 982.

118. The AAV capsid variant of any one of embodiments 1-117, wherein [N3] is present immediately subsequent to [N2].

119. The AAV capsid variant of any one of embodiments 1-118, which comprises from N-terminus to C-terminus, [N2]-[N3].

120. The AAV capsid variant of any one of embodiments 1-119, which comprises from N-terminus to C-terminus, [N1]-[N2]-[N3].

121. The AAV capsid variant of any one of embodiments 48-120, which comprises from N-terminus to C-terminus, [N0]-[N1]-[N2]-[N3].

122. The AAV capsid variant of any one of embodiments 39-121, which comprises from N-terminus to C-terminus, [N1]-[N2]-[N3]-[N4].

123. The AAV capsid variant of any one of embodiments 48-122, which comprises from N-terminus to C-terminus, [N0]-[N1]-[N2]-[N3]-[N4].

124. The AAV capsid variant of any one of the preceding embodiments, which comprises an amino acid other T at position 460 (e.g., N, I, C, H, R, L, D, Y, A, M, Q, I, E, K, P, G or S), numbered according to the amino acid sequence of SEQ ID NO: 138.

125. The AAV capsid variant of any one of the preceding embodiments, which comprises the amino acid N, I, C, H, R, L, D, Y, A, M, Q, I, E, K, P, G or S at position 460, numbered according to the amino acid sequence of SEQ ID NO: 138.

126. The AAV capsid variant of any one of the preceding embodiments, which comprises an amino acid other T at position 466 (e.g., N, I, C, H, R, L, D, Y, A, M, Q, I, E, K, P, G or S), numbered according to the amino acid sequence of any one of SEQ ID NOs: 36-59, 981, or 982.

127. The AAV capsid variant of any one of the preceding embodiments, which comprises the amino acid N, I, C, H, R, L, D, Y, A, M, Q, I, E, K, P, G or S at position 466, numbered according to the amino acid sequence of any one of SEQ ID NOs: 36-59, 981 or 982.

128. The AAV capsid variant of any one of the preceding embodiments, which comprises an amino acid other K at position 449 (e.g., an E, an N, or a T), numbered according to the amino acid sequence of any one of SEQ ID NOs: 36-59, 138, 981, or 982.

129. The AAV capsid variant of any one of the preceding embodiments, which comprises the amino E, N, or T at position 449, numbered according to the amino acid sequence of any one of SEQ ID NOs: 36-59, 138, 981 or 982.

130. An AAV capsid variant, comprising [A][B] (SEQ ID NO: 4694), wherein:
  (i) [A] comprises the amino acid sequence of GSGSPH (SEQ ID NO: 4695); and
  (ii) [B] comprises X1 X2 X3 X4 X5 X6 X7, wherein:
    (a) position X1 is: S, C, F, or V;
    (b) position X2 is: K, L, R, I, E, Y, V, or S;
    (c) position X3 is: A, R, L, G, I, Y, S, F, or W;
    (d) position X4 is: W, Q, R, G, L, V, S, or F;
    (e) position X5 is: N, Y, R, C, K, or L;
    (f) position X6 is: Q, G, K, R, T, L, or Y; and
    (g) position X7 is: Q, L, R, or V;
  optionally wherein the AAV capsid variant comprises an amino acid modification, e.g., a conservative substitution, of any of the aforesaid amino acids in (a)-(g).

131. The AAV capsid variant of embodiment 130, wherein
  (a) position X1 is S;
  (b) position X2 is K or L;
  (c) position X3 is: A, R, or L;
  (d) position X4 is: Q or R;
  (e) position X5 is: N or R;
  (f) position X6 is: Q or R; and
  (g) position X7 is: Q, L, or R.

132. The AAV capsid variant of embodiment 130 or 131, wherein [B] comprises:

```
(i)
                                    (SEQ ID NO: 5247)
     SLLWNQQ, (SEQ ID NO: 5248)
     SKAQYYV, (SEQ ID NO: 5249)
     SKLRRQQ, (SEQ ID NO: 5250)
     SIWQNQQ, (SEQ ID NO: 5251)
     SKAGCGQ, (SEQ ID NO: 5252)
     SRAQNQQ, (SEQ ID NO: 5253)
     SKRLRQQ, (SEQ ID NO: 5254)
     SLRRNQQ, (SEQ ID NO: 5255)
     SRGRNQQ, (SEQ ID NO: 5256)
     SEIVNQQ, (SEQ ID NO: 5257)
     SSRRNQQ, (SEQ ID NO: 5258)
     CLLQNQQ, (SEQ ID NO: 5259)
     SKAFRLQ, (SEQ ID NO: 5260)
     CLAQNQQ, (SEQ ID NO: 5261)
     FLRQNQQ, (SEQ ID NO: 5262)
     SLRFNQQ, (SEQ ID NO: 5263)
     SYLRNQQ,
```

```
                     (SEQ ID NO: 5264)
CSLQNQQ, (SEQ ID NO: 5265)
VLWQNQQ, (SEQ ID NO: 5266)
SKWLLQQ, (SEQ ID NO: 5267)
SLWSNQQ, (SEQ ID NO: 5268)
SKRRLQQ, (SEQ ID NO: 5269)
SVYLNQQ, (SEQ ID NO: 5270)
SLWLNQQ, (SEQ ID NO: 5271)
SKAQRKL, (SEQ ID NO: 5272)
SKALRRQ, (SEQ ID NO: 5273)
SKAQRLR, (SEQ ID NO: 5274)
SKAQNQQ, (SEQ ID NO: 5275)
SKAQRRL, (SEQ ID NO: 5276)
SKARRQQ, (SEQ ID NO: 5277)
SKARRLQ, (SEQ ID NO: 5278)
SKSRRQQ, (SEQ ID NO: 5279)
SKARLRQ, (SEQ ID NO: 5280)
SKASKRQ, (SEQ ID NO: 5281)
VRRQNQQ, (SEQ ID NO: 5282)
SKAQLYR, (SEQ ID NO: 5283)
SLFRNQQ, (SEQ ID NO: 5284)
SKAQLTV;
```

(ii) an amino acid sequence comprising any portion of an amino acid sequence in (i), e.g., any 2, 3, 4, 5, or 6 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

133. The AAV capsid variant of any one of embodiments 130-132, wherein [A] [B] comprises:

(i)
```
                     (SEQ ID NO: 5285)
GSGSPHSLLWNQQ, (SEQ ID NO: 2060)
GSGSPHSKAQYYV, (SEQ ID NO: 2061)
GSGSPHSKLRRQQ, (SEQ ID NO: 5286)
GSGSPHSIWQNQQ, (SEQ ID NO: 2062)
GSGSPHSKAGCGQ, (SEQ ID NO: 2063)
GSGSPHSRAQNQQ, (SEQ ID NO: 2064)
GSGSPHSKRLRQQ, (SEQ ID NO: 2065)
GSGSPHSLRRNQQ, (SEQ ID NO: 2066)
GSGSPHSRGRNQQ, (SEQ ID NO: 5287)
GSGSPHSEIVNQQ, (SEQ ID NO: 2067)
GSGSPHSSRRNQQ, (SEQ ID NO: 5288)
GSGSPHCLLQNQQ, (SEQ ID NO: 2068)
GSGSPHSKAFRLQ, (SEQ ID NO: 5289)
GSGSPHCLAQNQQ, (SEQ ID NO: 2070)
GSGSPHFLRQNQQ, (SEQ ID NO: 2071)
GSGSPHSLRFNQQ, (SEQ ID NO: 5290)
GSGSPHSYLRNQQ, (SEQ ID NO: 5291)
GSGSPHCSLQNQQ, (SEQ ID NO: 5292)
GSGSPHVLWQNQQ, (SEQ ID NO: 2072)
GSGSPHSKWLLQQ, (SEQ ID NO: 5293)
GSGSPHSLWSNQQ, (SEQ ID NO: 2073)
GSGSPHSKRRLQQ, (SEQ ID NO: 5294)
GSGSPHSVYLNQQ, (SEQ ID NO: 5295)
GSGSPHSLWLNQQ, (SEQ ID NO: 2074)
GSGSPHSKAQRKL, (SEQ ID NO: 2075)
GSGSPHSKALRRQ, (SEQ ID NO: 2076)
GSGSPHSKAQRLR,
```

-continued

GSGSPHSKAQNQQ, (SEQ ID NO: 1801)

GSGSPHSKAQRRL, (SEQ ID NO: 2077)

GSGSPHSKARRQQ, (SEQ ID NO: 2078)

GSGSPHSKARRLQ, (SEQ ID NO: 2079)

GSGSPHSKSRRQQ, (SEQ ID NO: 2080)

GSGSPHSKARLRQ, (SEQ ID NO: 2082)

GSGSPHSKASKRQ, (SEQ ID NO: 2083)

GSGSPHVRRQNQQ, (SEQ ID NO: 2084)

GSGSPHSKAQLYR, (SEQ ID NO: 2085)

GSGSPHSLFRNQQ, (SEQ ID NO: 5296)

GSGSPHSKAQLTV; (SEQ ID NO: 2086)

(ii) an amino acid sequence comprising any portion of an amino acid sequence in (i), e.g., any 2, 3, 4, 5, 6, 7, 8, 9, 10, 11, or 12 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i)

134. The AAV capsid variant of any one of embodiments 130-133, which further comprises one, two, or all of an amino acid other than T at position 450 (e.g., S, Y, or G), an amino acid other than I at position 451 (e.g., M or L), and/or an amino acid other than N at position 452 (e.g., S), relative to a reference sequence numbered according to the amino acid sequence of SEQ ID NO: 138.

135. The AAV capsid variant of any one of embodiments 130-134, which further comprises an S at position 450 and an M at position 451, relative to a reference sequence numbered according to the amino acid sequence of SEQ ID NO: 138.

136. The AAV capsid variant of any one of embodiments 130-134, which further comprises a Y at position 450, an L at position 451, and an S at position 452, relative to a reference sequence numbered according to the amino acid sequence of SEQ ID NO: 138.

137. The AAV capsid variant of any one of embodiments 130-134, which further comprises a G at position 450, an L at position 451, and an S at position 452, relative to a reference sequence numbered according to the amino acid sequence of SEQ ID NO: 138.

138. The AAV capsid variant of any one of embodiments 130-137, wherein [A][B] is present in loop IV.

139. The AAV capsid variant of any one of embodiments 130-138, wherein [A] is present immediately subsequent to position 452, relative to a reference sequence numbered according to the amino acid sequence of SEQ ID NO: 138.

140. The AAV capsid variant of any one of embodiments 130-139, wherein [A] replaces positions 453-455 (e.g., G453, S454, G455), relative to a reference sequence numbered according to the amino acid sequence of SEQ ID NO: 138.

141. The AAV capsid variant of any one of embodiments 130-140, wherein [A] is present immediately subsequent to position 452, and wherein [A] replaces positions 453-455 (e.g., G453, S454, G455), relative to a reference sequence numbered according to the amino acid sequence of SEQ ID NO: 138.

142. The AAV capsid variant of any one of embodiments 130-141, wherein [B] is present immediately subsequent to [A].

143. The AAV capsid variant of any one of embodiments 130-142, wherein [B] replaces positions 456-459 (e.g., Q456, N457, Q458, Q459), relative to a reference sequence numbered according to the amino acid sequence of SEQ ID NO: 138.

144. The AAV capsid variant of any one of embodiments 130-143, wherein [A][B] replaces positions 453-459 (e.g., G453, S454, G455, Q456, N457, Q458, Q459), relative to a reference sequence numbered according to the amino acid sequence of SEQ ID NO: 138.

145. The AAV capsid variant of any one of embodiments 130-144, wherein [A][B] is present immediately subsequent to position 452, and wherein [A][B] replaces positions 453-459 (e.g., G453, S454, G455, Q456, N457, Q458, Q459), relative to a reference sequence numbered according to the amino acid sequence of SEQ ID NO: 138.

146. The AAV capsid variant of any one of embodiments 130-145, which comprises from N-terminus to C-terminus, [A][B].

147. An AAV capsid comprising [A][B] (SEQ ID NO: 4699), wherein:

(i) [A] comprises X1 X2 X3 X4 X5 X6, wherein (a) position X1 is T, M, A, C, I, R, L, D, F, V, Q, N, or H;

(b) position X2 is I, P, E, N, D, S, A, T, M, or Q;

(c) position X3 is N, E, G, Y, W, M, T, I, K, Q, F, S, V, A, or L;

(d) position X4 is G, D, R, or E;

(e) position X5 is H, Q, N, or D;

(f) position X6 is D or R;

optionally wherein the AAV capsid variant comprises an amino acid modification, e.g., a conservative substitution, of any of the aforesaid amino acids in (a)-(f); and (ii) [B] comprises SPHKSG (SEQ ID NO: 946).

148. The AAV capsid of embodiment 147, wherein (a) position X1 is: T, M, A, or I;

(b) position X2 is: E, I or D;

(c) position X3 is: N, Q, Y, I, M, or V;

(d) position X4 is G;

(e) position X5 is H; and (f) position X6 is D.

149. The AAV capsid variant of embodiment 147 or 148, wherein [A] comprises:

(i)

TINGHD, (SEQ ID NO: 5297)

MPEGHD, (SEQ ID NO: 5298)

MEGGHD, (SEQ ID NO: 5299)

MEYGHD, (SEQ ID NO: 5300)

AEWGHD, (SEQ ID NO: 5301)

CEWGHD, (SEQ ID NO: 5302)

ANNGQD, (SEQ ID NO: 5303)

IPEGHD, (SEQ ID NO: 5304)

ADMGHD, (SEQ ID NO: 5305)

IEYGHD, (SEQ ID NO: 5306)

ADYGHD, (SEQ ID NO: 5307)

IETGHD, (SEQ ID NO: 5308)

MEWGHD, (SEQ ID NO: 5309)

CEYGHD, (SEQ ID NO: 5310)

RINGHD, (SEQ ID NO: 5311)

MEIGHD, (SEQ ID NO: 5312)

LEYGHD, (SEQ ID NO: 5313)

ADWGHD, (SEQ ID NO: 5314)

IEIGHD, (SEQ ID NO: 5315)

TIKDND, (SEQ ID NO: 5316)

DIMGHD, (SEQ ID NO: 5317)

FEQGHD, (SEQ ID NO: 5318)

MEFGHD, (SEQ ID NO: 5319)

CDQGHD, (SEQ ID NO: 5320)

LPEGHD, (SEQ ID NO: 5321)

IENGHD, (SEQ ID NO: 5322)

MESGHD, (SEQ ID NO: 5323)

AEIGHD, (SEQ ID NO: 5324)

VEYGHD, (SEQ ID NO: 5325)

TSNGDD, (SEQ ID NO: 5326)

IEVGHD, (SEQ ID NO: 5327)

MEMGHD, (SEQ ID NO: 5328)

AEVGHD, (SEQ ID NO: 5329)

MDAGHD, (SEQ ID NO: 5330)

VEWGHD, (SEQ ID NO: 5331)

AEQGHD, (SEQ ID NO: 5332)

LEWGHD, (SEQ ID NO: 5333)

MELGHD, (SEQ ID NO: 5334)

METGHD, (SEQ ID NO: 5335)

MEAGHD, (SEQ ID NO: 5336)

TINRQR, (SEQ ID NO: 5337)

IESGHD, (SEQ ID NO: 5338)

TAKDHD, (SEQ ID NO: 5339)

MEVGHD, (SEQ ID NO: 5340)

CEIGHD, (SEQ ID NO: 5341)

ATNGHD, (SEQ ID NO: 5342)

MDGGHD, (SEQ ID NO: 5343)

QEVGHD, (SEQ ID NO: 5344)

ADQGHD, (SEQ ID NO: 5345)

NMNGHD, (SEQ ID NO: 5346)

TPWEHD, (SEQ ID NO: 5347)

-continued

IEMGHD, (SEQ ID NO: 5348)

TANEHD, (SEQ ID NO: 5349)

QQQGHD, (SEQ ID NO: 5350)

TPQDHD, (SEQ ID NO: 5351)

HDWGHD, (SEQ ID NO: 5352)

IEGGHD, (SEQ ID NO: 5353)

(ii) an amino acid sequence comprising any portion of an amino acid sequence in (i), e.g., any 2, 3, 4, or 5 amino acids, e.g., consecutive amino acids, thereof;
(iii) an amino acid sequence comprising one, two, or three but no more than four modifications, e.g., substitutions (e.g., conservative substitutions), insertions, or deletions, relative to any of the amino acid sequences in (i); or
(iv) an amino acid sequence comprising one, two, or three but no more than four different amino acids, relative to any one of the amino acid sequences in (i).

150. The AAV capsid variant of any one of embodiments 147-149, wherein [A] [B] comprises:

(i)

TINGHDSPHKR, (SEQ ID NO: 5354)

MPEGHDSPHKS, (SEQ ID NO: 5355)

MEGGHDSPHKS, (SEQ ID NO: 5356)

MEYGHDSPHKS, (SEQ ID NO: 5357)

AEWGHDSPHKS, (SEQ ID NO: 5358)

CEWGHDSPHKS, (SEQ ID NO: 5359)

ANNGQDSPHKS, (SEQ ID NO: 5360)

IPEGHDSPHKS, (SEQ ID NO: 5361)

ADMGHDSPHKS, (SEQ ID NO: 5362)

IEYGHDSPHKS, (SEQ ID NO: 5363)

ADYGHDSPHKS, (SEQ ID NO: 5364)

IETGHDSPHKS, (SEQ ID NO: 5365)

MEWGHDSPHKS, (SEQ ID NO: 5366)

CEYGHDSPHKS, (SEQ ID NO: 5367)

RINGHDSPHKS, (SEQ ID NO: 5368)

MEIGHDSPHKS, (SEQ ID NO: 5369)

LEYGHDSPHKS, (SEQ ID NO: 5370)

ADWGHDSPHKS, (SEQ ID NO: 5371)

IEIGHDSPHKS, (SEQ ID NO: 5372)

TIKDNDSPHKS, (SEQ ID NO: 5373)

DIMGHDSPHKS, (SEQ ID NO: 5374)

FEQGHDSPHKS, (SEQ ID NO: 5375)

MEFGHDSPHKS, (SEQ ID NO: 5376)

CDQGHDSPHKS, (SEQ ID NO: 5377)

LPEGHDSPHKS, (SEQ ID NO: 5378)

IENGHDSPHKS, (SEQ ID NO: 5379)

MESGHDSPHKS, (SEQ ID NO: 5380)

AEIGHDSPHKS, (SEQ ID NO: 5381)

VEYGHDSPHKS, (SEQ ID NO: 5382)

TSNGDDSPHKS, (SEQ ID NO: 5383)

IEVGHDSPHKS, (SEQ ID NO: 5384)

MEMGHDSPHKS, (SEQ ID NO: 5385)

AEVGHDSPHKS, (SEQ ID NO: 5386)

MDAGHDSPHKS, (SEQ ID NO: 5387)

VEWGHDSPHKS, (SEQ ID NO: 5388)

AEQGHDSPHKS, (SEQ ID NO: 5389)

LEWGHDSPHKS, (SEQ ID NO: 5390)

MELGHDSPHKS, (SEQ ID NO: 5391)

METGHDSPHKS, (SEQ ID NO: 5392)

MEAGHDSPHKS, (SEQ ID NO: 5393)

TINRQRSPHKS, (SEQ ID NO: 5394)

```
                    (SEQ ID NO: 5395)
IESGHDSPHKS, (SEQ ID NO: 5396)
TAKDHDSPHKS, (SEQ ID NO: 5397)
MEVGHDSPHKS, (SEQ ID NO: 5398)
CEIGHDSPHKS, (SEQ ID NO: 5399)
ATNGHDSPHKS, (SEQ ID NO: 5400)
MDGGHDSPHKS, (SEQ ID NO: 5401)
QEVGHDSPHKS, (SEQ ID NO: 5402)
ADQGHDSPHKS, (SEQ ID NO: 5403)
NMNGHDSPHKS, (SEQ ID NO: 5404)
TPWEHDSPHKS, (SEQ ID NO: 5405)
IEMGHDSPHKS, (SEQ ID NO: 5406)
TANEHDSPHKS, (SEQ ID NO: 5407)
TINGHDSPHKS, (SEQ ID NO: 5408)
QQQGHDSPHKS, (SEQ ID NO: 5409)
TPQDHDSPHKS, (SEQ ID NO: 5410)
HDWGHDSPHKS, (SEQ ID NO: 5411)
IEGGHDSPHKS
```

(ii) an amino acid sequence comprising any portion of an amino acid sequence in (i), e.g., any 2, 3, 4, 5, 6, 7, 8, 9, or 10 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

151. The AAV capsid variant of any one of embodiments 147-150, which further comprises one, two, three, four, or all of an amino acid other than Q at position 456 (e.g., R or L), N at position 457 (e.g., H, K, or R), Q at position 458 (e.g., R or T), Q at position 459 (H), and/or T at position 460 (N or S), relative to a reference sequence numbered according to the amino acid sequence of SEQ ID NO: 138.

152. The AAV capsid variant of any one of embodiments 147-151, which further comprises an R at position 456, relative to a reference sequence numbered according to the amino acid sequence of SEQ ID NO: 138.

153. The AAV capsid variant of any one of embodiments 147-151, which further comprises an L at position 456, relative to a reference sequence numbered according to the amino acid sequence of SEQ ID NO: 138.

154. The AAV capsid variant of any one of embodiments 147-153, which further comprises an H at position 457 and an R at position 458, relative to a reference sequence numbered according to the amino acid sequence of SEQ ID NO: 138.

155. The AAV capsid variant of any one of embodiments 147-153, which further comprises a K at position 457 and an N at position 460, relative to a reference sequence numbered according to the amino acid sequence of SEQ ID NO: 138.

156. The AAV capsid variant of any one of embodiments 147-153, which further comprises a T at position 458, an H at position 459, and an S at position 460, relative to a reference sequence numbered according to the amino acid sequence of SEQ ID NO: 138.

157. The AAV capsid variant of any one of embodiments 147-151, which further comprises an R at position 456, an R at position 457, and an R at position 458, relative to a reference sequence numbered according to the amino acid sequence of SEQ ID NO: 138.

158. The AAV capsid variant of any one of embodiments 147-157, wherein [A] [B] is present in loop IV.

159. The AAV capsid variant of any one of embodiments 147-158, wherein [A] is present immediately subsequent to position 449, relative to a reference sequence numbered according to the amino acid sequence of SEQ ID NO: 138.

160. The AAV capsid variant of any one of embodiments 147-159, wherein [A] replaces positions 450-453 (e.g., T450, I451, N452, G453), relative to a reference sequence numbered according to the amino acid sequence of SEQ ID NO: 138.

161. The AAV capsid variant of any one of embodiments 147-160, wherein [A] is present immediately subsequent to position 449, and wherein [A] replaces positions 450-453 (e.g., T450, I451, N452, G453), relative to a reference sequence numbered according to the amino acid sequence of SEQ ID NO: 138.

162. The AAV capsid variant of any one of embodiments 147-161, wherein [A][B] replaces positions 450-455 (e.g., T450, I451, N452, G453, S454, G455), relative to a reference sequence numbered according to the amino acid sequence of SEQ ID NO: 138.

163. The AAV capsid variant of any one of embodiments 147-162, wherein [A][B] is present immediately subsequent to position 449, and wherein [A][B] replaces positions 450-455 (e.g., T450, 1451, N452, G453, S454, G455), relative to a reference sequence numbered according to the amino acid sequence of SEQ ID NO: 138.

164. The AAV capsid variant of any one of embodiments 147-163, wherein [B] is present immediately subsequent [A], and replaces positions 454 and 455 (e.g., S454 and G455), relative to a reference sequence numbered according to the amino acid sequence of SEQ ID NO: 138.

165. The AAV capsid variant of any one of embodiments 147-164, wherein [B] is present immediately subsequent to position 455, relative to a reference sequence numbered according to the amino acid sequence of SEQ ID NO: 982.

166. The AAV capsid variant of any one of embodiments 147-165, wherein [B] is present immediately subsequent to [A].

167. The AAV capsid variant of any one of embodiments 147-166, which comprises from N-terminus to C-terminus, [A][B].

168. An AAV capsid variant comprising an amino acid sequence having the following formula: [N1]-[N2]-[N3] (SEQ ID NO: 6407), wherein:
 (i) [N1] comprises positions X1, X2, and X3, wherein position X2 is S and position X3 is G;
 (ii) [N2] comprises the amino acid sequence SPH; and
 (iii) [N3] comprises positions X4, X5, and X6, wherein position X5 is K.

169. The AAV capsid variant of embodiment 168, wherein:
 (i) X4 of [N3] is S, T, N, or A; and
 (ii) X5 of [N3] is A, V, T, S, G, R, L, or N;
 optionally wherein the AAV capsid variant comprises an amino acid modification, e.g., a conservative substitution, of any of the aforesaid amino acids in (i) or (ii).

170. The AAV capsid variant of embodiment 168 or 169, wherein X4 is S and/or X5 is A.

171. The AAV capsid variant of any one of embodiments 168-170, wherein [N3] comprises SK, TK, NK, AK, KA, KV, KT, KS, KG, KR, KL, or KN.

172. The AAV capsid variant of any one of embodiments 168-171, wherein [N3] is or comprises SKA, SKV, SKT, SKS, SKG, SKR, TKA, NKA, SKL, SKN, or AKA.

173. The AAV capsid variant of any one of embodiments 168-172, wherein [N3] is or comprises SKA.

174. The AAV capsid variant of any one of embodiments 168-173, wherein [N2]-[N3] comprises SPHSK (SEQ ID NO: 4701), SPHTK (SEQ ID NO: 4725), SPHNK (SEQ ID NO: 4726), or SPHAK (SEQ ID NO: 4727).

175. The AAV capsid variant of any one of embodiments 168-174, wherein [N2]-[N3] is or comprises:

```
(i)
                                 (SEQ ID NO: 941)
SPHSKA,
                                 (SEQ ID NO: 4737)
SPHSKV,
                                 (SEQ ID NO: 4731)
SPHSKT,
                                 (SEQ ID NO: 962)
SPHSKS,
                                 (SEQ ID NO: 4732)
SPHSKG,
                                 (SEQ ID NO: 978)
SPHSKR,
                                 (SEQ ID NO: 4739)
SPHTKA,
                                 (SEQ ID NO: 4734)
SPHNKA,
                                 (SEQ ID NO: 960)
SPHSKL,
                                 (SEQ ID NO: 4735)
SPHSKN,
or
                                 (SEQ ID NO: 4736)
SPHAKA;
```

(ii) an amino acid sequence comprising any portion of an amino acid sequence in (i), e.g., any 2, 3, 4, or 5 amino acids, e.g., consecutive amino acids, thereof;
 (iii) an amino acid sequence comprising one, two, or three but no more than four modifications, e.g., substitutions (e.g., conservative substitutions), insertions, or deletions, relative to any of the amino acid sequences in (i); or
 (iv) an amino acid sequence comprising one, two, or three but no more than four different amino acids, relative to any one of the amino acid sequences in (i).

176. The AAV capsid variant of any one of embodiments 168-175, wherein [N2]-[N3] is or comprises SPHSKA (SEQ ID NO: 941).

177. The AAV capsid variant of any one of embodiments 168-176, which comprises an amino acid other than G at position 453 (e.g., M, T, I, E, S, A, N, V, L, K, H, P, R, W, or D), numbered according to SEQ ID NO: 138 or 981.

178. The AAV capsid variant of any one of embodiments 168-177, which comprises the amino acid G at position 453, numbered according to SEQ ID NO: 138 or 981.

179. The AAV capsid variant of any one of embodiments 168-178, wherein X1 of [N1] is chosen from: G, M, T, I, E, S, A, N, V, L, K, H, P, R, W, or D; optionally wherein the AAV capsid variant comprises an amino acid modification, e.g., a conservative substitution, of any of the aforesaid amino acids.

180. The AAV capsid variant of any one of embodiments 168-179, wherein [N1] comprises SG, GS, MS, TS, IS, ES, SS, AS, NS, VS, LS, KS, HS, PS, RS, WS, or DS.

181. The AAV capsid variant of any one of embodiments 168-180, wherein [N1] is or comprises: GSG, MSG, TSG, ISG, ESG, SSG, ASG, NSG, VSG, LSG, KSG, HSG, PSG, RSG, WSG, or DSG.

182. The AAV capsid variant of any one of embodiments 168-181, wherein [N1] is or comprises GSG.

183. The AAV capsid variant of any one of embodiments 168-182, wherein [N1]-[N2] comprises SGSPH (SEQ ID NO: 4752).

184. The AAV capsid variant of any one of embodiments 168-183, wherein [N1]-[N2] is or comprises:

```
(i)
                                 (SEQ ID NO: 4695)
GSGSPH,
                                 (SEQ ID NO: 4798)
MSGSPH,
                                 (SEQ ID NO: 4800)
TSGSPH,
                                 (SEQ ID NO: 4801)
ISGSPH,
                                 (SEQ ID NO: 4803)
ESGSPH,
                                 (SEQ ID NO: 4804)
SSGSPH,
                                 (SEQ ID NO: 4806)
ASGSPH,
                                 (SEQ ID NO: 4807)
NSGSPH,
                                 (SEQ ID NO: 4786)
VSGSPH,
```

-continued

| | |
|---|---|
| LSGSPH, | (SEQ ID NO: 4808) |
| KSGSPH, | (SEQ ID NO: 4810) |
| HSGSPH, | (SEQ ID NO: 4811) |
| PSGSPH, | (SEQ ID NO: 4813) |
| RSGSPH, | (SEQ ID NO: 4815) |
| WSGSPH, | (SEQ ID NO: 4817) |
| DSGSPH; | (SEQ ID NO: 4818) |

(ii) an amino acid sequence comprising any portion of an amino acid sequence in i, e.g., any 2, 3, 4, or 5 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

185. The AAV capsid variant of any one of embodiments 168-184, wherein [N1]-[N2]-[N3] is or comprises:

(i)

| | |
|---|---|
| GSGSPHSKA, | (SEQ ID NO: 4697) |
| GSGSPHSKV, | (SEQ ID NO: 4956) |
| MSGSPHSKA, | (SEQ ID NO: 4957) |
| TSGSPHSKA, | (SEQ ID NO: 4959) |
| ISGSPHSKA, | (SEQ ID NO: 4960) |
| GSGSPHSKT, | (SEQ ID NO: 4962) |
| ESGSPHSKA, | (SEQ ID NO: 4963) |
| SSGSPHSKA, | (SEQ ID NO: 4964) |
| GSGSPHSKS, | (SEQ ID NO: 4953) |
| ASGSPHSKA, | (SEQ ID NO: 4966) |
| NSGSPHSKA, | (SEQ ID NO: 4967) |
| VSGSPHSKA, | (SEQ ID NO: 4913) |
| LSGSPHSKA, | (SEQ ID NO: 4968) |
| KSGSPHSKA, | (SEQ ID NO: 4970) |
| GSGSPHSKG, | (SEQ ID NO: 4972) |
| GSGSPHSKR, | (SEQ ID NO: 4945) |
| HSGSPHSKA, | (SEQ ID NO: 4973) |
| PSGSPHSKA, | (SEQ ID NO: 4975) |
| RSGSPHSKA, | (SEQ ID NO: 4977) |
| GSGSPHTKA, | (SEQ ID NO: 4978) |
| WSGSPHSKA, | (SEQ ID NO: 4980) |
| DSGSPHSKA, | (SEQ ID NO: 4981) |
| GSGSPHNKA, | (SEQ ID NO: 4983) |
| GSGSPHSKL, | (SEQ ID NO: 4943) |
| GSGSPHSKN, or | (SEQ ID NO: 4994) |
| GSGSPHAKA; | (SEQ ID NO: 4995) |

(ii) an amino acid sequence comprising any portion of an amino acid sequence in (i), e.g., any 2, 3, 4, 5, 6, 7, 8, or 9 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

186. The AAV capsid variant of any one of embodiments 168-185, wherein [N1]-[N2]-[N3] is or comprises GSGSPHSKA (SEQ ID NO: 4697).

187. The AAV capsid variant of any one of embodiments 168-186, which comprises an amino acid other than Q at position 456 (e.g., R, P, H, L, K, I, G, S, M, or E), an amino acid other than N at position 457 (e.g., D, V, S, P, T, G, Y, W, E, R, H, K, F, A, I, L, or M), an amino acid other than Q at position 458 (e.g., R, L, A, P, H, T, I, F, K, V, M, G, W, Y, S, E, N, or D), an amino acid other than Q at position 459 (e.g., H, K, A, L, P, E, M, I, S, N, R, Y, C, V, T, W, D, G), and/or an amino acid other than T at position 460 (e.g., I, N, S, H, R, L, D, Y, A, or Q), relative to a reference sequence numbered according to SEQ ID NO: 138.

188. The AAV capsid variant of any one of embodiments 168-187, which comprises an amino acid other than Q at position 462 (e.g., R, P, H, L, K, I, G, S, M, or E), an amino acid other than N at position 463 (e.g., D, V, S, P, T, G, Y, W, E, R, H, K, F, A, I, L, or M), an amino acid other than Q at position 464 (e.g., R, L, A, P, H, T, I, F, K, V, M, G, W, Y, S, E, N, or D), an amino acid other than Q at position 465 (e.g., H, K, A, L, P, E, M, I, S, N, R, Y, C, V, T, W, D, G), and/or an amino acid other than T at position 466 (e.g., I, N, S, H, R, L, D, Y, A, or Q), relative to a reference sequence numbered according to SEQ ID NO: 981.
189. The AAV capsid variant of any one of embodiments 168-188, which comprises the amino acid Q at position 456, the amino acid N at position 457, the amino acid Q at position 458, the amino acid Q at position 459, and/or the amino acid T at position 460, relative to a reference sequence numbered according to SEQ ID NO: 138.
190. The AAV capsid variant of any one of embodiments 168-189, which comprises the amino acid Q at position 462, the amino acid N at position 463, the amino acid Q at position 464, the amino acid Q at position 465, and/or the amino acid T at position 466, numbered according to SEQ ID NO: 981
191. The AAV capsid variant of any one of embodiments 168-190, further comprising [N4] wherein [N4] comprises X7, X8, X9, X10, and X11, wherein:
  (a) X7 is Q, R, P, H, L, K, I, G, S, M, or E;
  (b) X8 is N, D, V, S, P, T, G, Y, W, E, R, H, K, F, A, I, L, or M;
  (c) X9 is Q, R, L, A, P, H, T, I, F, K, V, M, G, W, Y, S, E, N, D;
  (d) X10 is Q, H, K, A, L, P, E, M, I, S, N, R, Y, C, V, T, W, D, G; and
  (e) X11 is T, I, N, S, H, R, L, D, Y, A, Q;
  optionally wherein the AAV capsid variant comprises an amino acid modification, e.g., a conservative substitution, of any of the aforesaid amino acids in (a)-(e).
192. The AAV capsid variant of embodiment 191, wherein [N4] is or comprises:

(i)
QNQQT, (SEQ ID NO: 5412)
QNRHT, (SEQ ID NO: 5413)
RDQQT, (SEQ ID NO: 5414)
PNLQT, (SEQ ID NO: 5415)
HVRQT, (SEQ ID NO: 5416)
PNQHT, (SEQ ID NO: 5417)
QSQQT, (SEQ ID NO: 5418)
QNQQI, (SEQ ID NO: 5419)
QPAKT, (SEQ ID NO: 5420)
QTQQN, (SEQ ID NO: 5421)
QNLAT, (SEQ ID NO: 5422)
QNQLT, (SEQ ID NO: 5423)
QGQQT, (SEQ ID NO: 5424)
LNRQS, (SEQ ID NO: 5425)
HNQQT, (SEQ ID NO: 5426)
QNPPT, (SEQ ID NO: 5427)
QNLQT, (SEQ ID NO: 5428)
QYQQT, (SEQ ID NO: 5429)
QDQET, (SEQ ID NO: 5430)
QNHQT, (SEQ ID NO: 5431)
QDQQT, (SEQ ID NO: 5432)
HWQQT, (SEQ ID NO: 5433)
PNQQT, (SEQ ID NO: 5434)
QNQLI, (SEQ ID NO: 5435)
PEQQT, (SEQ ID NO: 5436)
QRTMT, (SEQ ID NO: 5437)
QNQQH, (SEQ ID NO: 5438)
LHQHT, (SEQ ID NO: 5439)
QHRIT, (SEQ ID NO: 5440)
QYIHT, (SEQ ID NO: 5441)
QKFET, (SEQ ID NO: 5442)
QFPST, (SEQ ID NO: 5443)
HNQQR, (SEQ ID NO: 5444)
QAIKT, (SEQ ID NO: 5445)
QNRQT, (SEQ ID NO: 5446)
QYQHT, (SEQ ID NO: 5447)
QNPQS, (SEQ ID NO: 5448)
QHQLT, (SEQ ID NO: 5449)
QSPPT, (SEQ ID NO: 5450)

QAKLT, (SEQ ID NO: 5451)

KSQQT, (SEQ ID NO: 5452)

QDRPT, (SEQ ID NO: 5453)

QSQQL, (SEQ ID NO: 5454)

QAFHT, (SEQ ID NO: 5455)

QKQQD, (SEQ ID NO: 5456)

QNAQT, (SEQ ID NO: 5457)

HNQLT, (SEQ ID NO: 5458)

QNQQY, (SEQ ID NO: 5459)

QKLNT, (SEQ ID NO: 5460)

QNVQT, (SEQ ID NO: 5461)

QAQQT, (SEQ ID NO: 5462)

QNLQA, (SEQ ID NO: 5463)

QTPPT, (SEQ ID NO: 5464)

QYQHA, (SEQ ID NO: 5465)

QGQQA, (SEQ ID NO: 5466)

QPPAT, (SEQ ID NO: 5467)

QERPT, (SEQ ID NO: 5468)

QDLQT, (SEQ ID NO: 5469)

QAMHT, (SEQ ID NO: 5470)

LNQQT, (SEQ ID NO: 5471)

QHPST, (SEQ ID NO: 5472)

PGLQT, (SEQ ID NO: 5473)

QGIRT, (SEQ ID NO: 5474)

QAPAT, (SEQ ID NO: 5475)

QSQQI, (SEQ ID NO: 5476)

QIPPT, (SEQ ID NO: 5477)

QTQLT, (SEQ ID NO: 5478)

QAPST, (SEQ ID NO: 5479)

QNTYA, (SEQ ID NO: 5480)

QNQHI, (SEQ ID NO: 5481)

QNHLT, (SEQ ID NO: 5482)

QIGMT, (SEQ ID NO: 5483)

LNKQT, (SEQ ID NO: 5484)

QLQQT, (SEQ ID NO: 5485)

QRMST, (SEQ ID NO: 5486)

QGILT, (SEQ ID NO: 5487)

QDRQT, (SEQ ID NO: 5488)

RDWQT, (SEQ ID NO: 5489)

QNTHD, (SEQ ID NO: 5490)

PNLQI, (SEQ ID NO: 5491)

QERST, (SEQ ID NO: 5492)

QNYQT, (SEQ ID NO: 5493)

QRTCT, (SEQ ID NO: 5494)

QIGHT, (SEQ ID NO: 5495)

QGAIT, (SEQ ID NO: 5496)

QVPPT, (SEQ ID NO: 5497)

QVQQI, (SEQ ID NO: 5498)

LMRQT, (SEQ ID NO: 5499)

QYSVT, (SEQ ID NO: 5500)

QAITT, (SEQ ID NO: 5501)

QKTLT, (SEQ ID NO: 5502)

QNQWT, (SEQ ID NO: 5503)

QLHHT, (SEQ ID NO: 5504)

QNIII, (SEQ ID NO: 5505)

QGHHT, (SEQ ID NO: 5506)

QSKVT, (SEQ ID NO: 5507)

QLPST, (SEQ ID NO: 5508)

IGKQT, (SEQ ID NO: 5509)

QAIHT, (SEQ ID NO: 5510)

QHGLT, (SEQ ID NO: 5511)

QFMCT, (SEQ ID NO: 5512)

QHLQT, (SEQ ID NO: 5513)

QNHQN, (SEQ ID NO: 5514)

QPART, (SEQ ID NO: 5515)

QSLQT, (SEQ ID NO: 5516)

QSQLT, (SEQ ID NO: 5517)

QDRQS, (SEQ ID NO: 5518)

QMPST, (SEQ ID NO: 5519)

QGSLT, (SEQ ID NO: 5520)

QVPAT, (SEQ ID NO: 5521)

QDKQT, (SEQ ID NO: 5522)

HYQQT, (SEQ ID NO: 5523)

QVPST, (SEQ ID NO: 5524)

RGEQT, (SEQ ID NO: 5525)

PGQQT, (SEQ ID NO: 5526)

QSLQI, (SEQ ID NO: 5527)

LEQQT, (SEQ ID NO: 5528)

QNQST, (SEQ ID NO: 5529)

QKVIT, (SEQ ID NO: 5530)

QNNDQ, (SEQ ID NO: 5531)

QSVHT, (SEQ ID NO: 5532)

QPLGT, (SEQ ID NO: 5533)

HNQET, (SEQ ID NO: 5534)

QNLQI, (SEQ ID NO: 5535)

QIQQT, (SEQ ID NO: 5536)

QVRNT, (SEQ ID NO: 5537)

PSNQT, (SEQ ID NO: 5538)

QVGHT, (SEQ ID NO: 5539)

QRDIT, (SEQ ID NO: 5540)

QMPNT, (SEQ ID NO: 5541)

RGLQT, (SEQ ID NO: 5542)

QKQQT, (SEQ ID NO: 5543)

PSLQT, (SEQ ID NO: 5544)

QRDQT, (SEQ ID NO: 5545)

QAKGT, (SEQ ID NO: 5546)

QSAHT, (SEQ ID NO: 5547)

QSTMT, (SEQ ID NO: 5548)

QREMT, (SEQ ID NO: 5549)

QYRAT, (SEQ ID NO: 5550)

QWQQT, (SEQ ID NO: 5551)

QRMNT, (SEQ ID NO: 5552)

GDSQT, (SEQ ID NO: 5553)

QKIST, (SEQ ID NO: 5554)

PSMQT, (SEQ ID NO: 5555)

SPRQT, (SEQ ID NO: 5556)

MEQQT, (SEQ ID NO: 5557)

QYQNT, (SEQ ID NO: 5558)

-continued

QHQQT, (SEQ ID NO: 5559)

INQQT, (SEQ ID NO: 5560)

PNQQH, (SEQ ID NO: 5561)

ENRQT, (SEQ ID NO: 5562)

QTQQA, (SEQ ID NO: 5563)
or

QNQAT; (SEQ ID NO: 5564)

(ii) an amino acid sequence comprising any portion of an amino acid sequence in (i), e.g., any 2, 3, or 4 amino acids, e.g., consecutive amino acids, thereof;
(iii) an amino acid sequence comprising one, two, or three but no more than four modifications, e.g., substitutions (e.g., conservative substitutions), insertions, or deletions, relative to any of the amino acid sequences in (i); or
(iv) an amino acid sequence comprising one, two, or three but no more than four different amino acids, relative to any one of the amino acid sequences in (i).

193. The AAV capsid variant of embodiment 191 or 192, wherein [N1]-[N2]-[N3]-[N4] is or comprises:
(i) the amino acid sequence of any of SEQ ID NOs: 200 or 2887-3076;
(ii) an amino acid sequence comprising any portion of an amino acid sequence in (i), e.g., any 2, 3, 4, 5, 6, 7, 8, 9, 10, 11, 12, or 13 amino acids, e.g., consecutive amino acids, thereof;
(iii) an amino acid sequence comprising one, two, or three but no more than four modifications, e.g., substitutions (e.g., conservative substitutions), insertions, or deletions, relative to any of the amino acid sequences in (i); or
(iv) an amino acid sequence comprising one, two, or three but no more than four different amino acids, relative to any one of the amino acid sequences in (i).

194. The AAV capsid variant of any one of embodiments 191-193, wherein [N1]-[N2]-[N3]-[N4] is or comprises GSGSPHSKAQNQQT (SEQ ID NO: 200).

195. The AAV capsid variant of any one of embodiments 191-193, wherein [N1]-[N2]-[N3]-[N4] is or comprises VSGSPHSKAQNQQT (SEQ ID NO: 903).

196. The AAV capsid variant of any one of embodiments 168-195, which comprises an amino acid other than K at position 449 (e.g., T, E, or N), T at position 450 (e.g., S, E, A, N, V, Q, or G), an amino acid other than I at position 451 (e.g., F, E, V, L, D, S, C, T, A, N, H, R, G, or W), and/or an amino acid other than N at position 452 (e.g., I, P, K, R, H, S, M, Q, D, T, L, A, Y, V, F, E, W, or G), relative to a reference sequence numbered according to SEQ ID NO: 138 or 981.

197. The AAV capsid variant of any one of embodiments 168-196, which comprises the amino acid K at position 449, the amino acid T at position 450, the amino acid I at position 451, and/or the amino acid N at position 452, relative to a reference sequence numbered according to SEQ ID NO: 138 or 981.

198. The AAV capsid variant of any one of embodiments 168-197, which further comprises [N0], wherein [N0] comprises $X_A$, $X_B$, $X_C$, and $X_D$, wherein:
(a) $X_A$ is K, T, E, or N;
(b) $X_b$ is T, S, E, A, N, V, Q, or G;
(c) $X_C$ is I, F, E, V, L, D, S, C, T, A, N, H, R, G, or W; and
(d) $X_D$ is N, I, P, K, R, H, S, M, Q, D, T, L, A, Y, V, F, E, W, or G;
optionally wherein the AAV capsid variant comprises an amino acid modification, e.g., a conservative substitution, of any of the aforesaid amino acids in (a)-(d).

199. The AAV capsid variant of embodiment 198, wherein [N0] is or comprises:

(i)

KTII, (SEQ ID NO: 5565)

KTFP, (SEQ ID NO: 5566)

KTEK, (SEQ ID NO: 5567)

KTVN, (SEQ ID NO: 5568)

KTFN, (SEQ ID NO: 5569)

KTIN, (SEQ ID NO: 5570)

TTIN, (SEQ ID NO: 5571)

KSIN, (SEQ ID NO: 5572)

KTER, (SEQ ID NO: 5573)

KELH, (SEQ ID NO: 5574)

KAIN, (SEQ ID NO: 5575)

KTDN, (SEQ ID NO: 5576)

KTFH, (SEQ ID NO: 5577)

KTSN, (SEQ ID NO: 5578)

ETIN, (SEQ ID NO: 5579)

NTIN, (SEQ ID NO: 5580)

KTEN, (SEQ ID NO: 5581)

KTSS, (SEQ ID NO: 5582)

KTCN, (SEQ ID NO: 5583)

KTEH, (SEQ ID NO: 5584)

-continued

KAEM, (SEQ ID NO: 5585)

KATN, (SEQ ID NO: 5586)

KAIK, (SEQ ID NO: 5587)

KTDK, (SEQ ID NO: 5588)

KTFK, (SEQ ID NO: 5589)

KSDQ, (SEQ ID NO: 5590)

KTEI, (SEQ ID NO: 5591)

KTID, (SEQ ID NO: 5592)

KNTN, (SEQ ID NO: 5593)

KTET, (SEQ ID NO: 5594)

KTEL, (SEQ ID NO: 5595)

KNIN, (SEQ ID NO: 5596)

KTEA, (SEQ ID NO: 5597)

KTAN, (SEQ ID NO: 5598)

NTIY, (SEQ ID NO: 5599)

KTFS, (SEQ ID NO: 5600)

KTES, (SEQ ID NO: 5601)

KTTN, (SEQ ID NO: 5602)

KTED, (SEQ ID NO: 5603)

KTNN, (SEQ ID NO: 5604)

KEVH, (SEQ ID NO: 5605)

KTIS, (SEQ ID NO: 5606)

KTVR, (SEQ ID NO: 5607)

KTDR, (SEQ ID NO: 5608)

ETIK, (SEQ ID NO: 5609)

KNHI, (SEQ ID NO: 5610)

KESD, (SEQ ID NO: 5611)

KTIK, (SEQ ID NO: 5612)

KTDL, (SEQ ID NO: 5613)

KTVP, (SEQ ID NO: 5614)

KTVI, (SEQ ID NO: 5615)

KAEH, (SEQ ID NO: 5616)

KNCL, (SEQ ID NO: 5617)

KTVK, (SEQ ID NO: 5618)

KNAD, (SEQ ID NO: 5619)

KTIT, (SEQ ID NO: 5620)

KNCV, (SEQ ID NO: 5621)

KNAL, (SEQ ID NO: 5622)

KVIN, (SEQ ID NO: 5623)

KTEF, (SEQ ID NO: 5624)

KTRE, (SEQ ID NO: 5625)

KQGE, (SEQ ID NO: 5626)

KSEK, (SEQ ID NO: 5627)

KNVN, (SEQ ID NO: 5628)

KGGE, (SEQ ID NO: 5629)

KEFV, (SEQ ID NO: 5630)

KSDK, (SEQ ID NO: 5631)

KTEQ, (SEQ ID NO: 5632)

KEVQ, (SEQ ID NO: 5633)

KTEY, (SEQ ID NO: 5634)

KNCW, (SEQ ID NO: 5635)

KTDV, (SEQ ID NO: 5636)

KSDI, (SEQ ID NO: 5637)

KNSI, (SEQ ID NO: 5638)

-continued

```
                                     (SEQ ID NO: 5639)
KNSL, (SEQ ID NO: 5640)
KEVV, (SEQ ID NO: 5641)
KTEP, (SEQ ID NO: 5642)
KSEL, (SEQ ID NO: 5643)
KTWQ, (SEQ ID NO: 5644)
KTEV, (SEQ ID NO: 5645)
KAVN, (SEQ ID NO: 5646)
KGVL, (SEQ ID NO: 5647)
KTEG, (SEQ ID NO: 5648)
KTRD, (SEQ ID NO: 5649)
KTGN, (SEQ ID NO: 5650)
KNAI, (SEQ ID NO: 5651)
KAEN, (SEQ ID NO: 5652)
KAET, (SEQ ID NO: 5653)
KTVH, (SEQ ID NO: 5654)
KETA, (SEQ ID NO: 5655)
KNNL, (SEQ ID NO: 5656)
EAIN, (SEQ ID NO: 5657)
KSLN, (SEQ ID NO: 5658)
KTIP,
or
                                     (SEQ ID NO: 5659)
KTIH;
```

(ii) an amino acid sequence comprising any portion of an amino acid sequence in (i), e.g., any 2, or 3 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

200. The AAV capsid variant of embodiment 198 or 199, wherein [N0]-[N1]-[N2]-[N3]-[N4] is or comprises:
  (i) the amino acid sequence of any one of SEQ ID NOs: 3239-3526 or 3591-3605;
  (ii) an amino acid sequence comprising any portion of an amino acid sequence in (i), e.g., any 2, 3, 4, 5, 6, 7, 8, 9, 10, 11, 12, 13, 14, 15, 16, or 17 amino acids, e.g., consecutive amino acids, thereof;
  (iii) an amino acid sequence comprising one, two, or three but no more than four modifications, e.g., substitutions (e.g., conservative substitutions), insertions, or deletions, relative to any of the amino acid sequences in (i); or
  (iv) an amino acid sequence comprising one, two, or three but no more than four different amino acids, relative to any one of the amino acid sequences in (i).

201. The AAV capsid variant of any one of embodiments 198-200, wherein [N0]-[N1]-[N2]-[N3]-[N4] is or comprises KTINGSGSPHSKAQNQQT (SEQ ID NO: 5660).

202. The AAV capsid variant of any one of embodiments 198-200, wherein [N0]-[N1]-[N2]-[N3]-[N4] is or comprises KTERVSGSPHSKAQNQQT (SEQ ID NO: 3589).

203. An AAV capsid variant comprising an amino acid sequence having the following formula: [N1]-[N2]-[N3] (SEQ ID NO: 6408), wherein:
  (i) [N1] comprises positions X1, X2, and X3, wherein position X2 is an amino acid other than S and position X3 is an amino acid other than G;
  (ii) [N2] comprises the amino acid sequence SPH; and
  (iii) [N3] comprises positions X4, X5, and X6, wherein position X4 is K.

204. The AAV capsid variant of embodiment 203, wherein:
  (i) X5 of [N3] is S, I, T, R, H, Y, L, or M; and
  (ii) X6 of [N3] is G, A, L, E, V, R, W, N, Q, or K;
  optionally wherein the AAV capsid variant comprises an amino acid modification, e.g., a conservative substitution, of any of the aforesaid amino acids in (i) or (ii).

205. The AAV capsid variant of embodiment 203 or 204, wherein X5 is S and/or $X_6$ is G.

206. The AAV capsid variant of any one of embodiments 203-205, wherein [N3] comprises KS, KI, KT, KR, KH, KY, KL, KM, SG, IG, TG, RG, SA, SL, SE, SV, SR, SW, SN, HG, YG, SQ, IV, SK, LW, MG, or MA.

207. The AAV capsid variant of any one of embodiments 203-206, wherein [N3] is or comprises KSG, KIG, KTG, KRG, KSA, KSL, KSE, KSV, KSR, KSW, KSN, KHG, KYG, KSQ, KIV, KSK, KLW, KMG, or KMA.

208. The AAV capsid variant of any one of embodiments 203-207, wherein [N3] is or comprises KSG.

209. The AAV capsid variant of any one of embodiments 203-208, wherein [N2]-[N3] comprises SPHKS (SEQ ID NO: 4704), SPHKI (SEQ ID NO: 4713), SPHKT (SEQ ID NO: 4711), SPHKR (SEQ ID NO: 4717), NPHKS (SEQ ID NO: 5661), SPHKH (SEQ ID NO: 4728), SPHKY (SEQ ID NO: 4715), SPHKL (SEQ ID NO: 4714), or SPHKM (SEQ ID NO: 4729).

210. The AAV capsid variant of any one of embodiments 203-209, wherein [N2]-[N3] is or comprises:

```
    (i)
                                     (SEQ ID NO: 946)
SPHKSG, (SEQ ID NO: 958)
SPHKIG,
```

-continued

| | |
|---|---|
| SPHKTG, | (SEQ ID NO: 4738) |
| SPHKRG, | (SEQ ID NO: 974) |
| NPHKSG, | (SEQ ID NO: 5662) |
| SPHKSA, | (SEQ ID NO: 977) |
| SPHKSL, | (SEQ ID NO: 4740) |
| SPHKSE, | (SEQ ID NO: 4741) |
| SPHKSV, | (SEQ ID NO: 4742) |
| SPHKSR, | (SEQ ID NO: 951) |
| SPHKSW, | (SEQ ID NO: 4743) |
| SPHKSN, | (SEQ ID NO: 4744) |
| SPHKHG, | (SEQ ID NO: 4745) |
| SPHKYG, | (SEQ ID NO: 966) |
| SPHKSQ, | (SEQ ID NO: 4746) |
| SPHKIV, | (SEQ ID NO: 5663) |
| SPHKSK, | (SEQ ID NO: 4747) |
| SPHKLW, | (SEQ ID NO: 4748) |
| SPHKMG, or | (SEQ ID NO: 4750) |
| SPHKMA; | (SEQ ID NO: 4751) |

(ii) an amino acid sequence comprising any portion of an amino acid sequence in (i), e.g., any 2, 3, 4, or 5 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

211. The AAV capsid variant of any one of embodiments 203-210, wherein [N2]-[N3] is or comprises SPHKSG (SEQ ID NO: 946).

212. The AAV capsid variant of any one of embodiments 203-211, which comprises an amino acid other than G at position 453 (e.g., A, K, W, R, L, I, M, N, T, E, Q, Y, H, F, or V), numbered according to SEQ ID NO: 138 or 981.

213. The AAV capsid variant of any one of embodiments 203-212, which comprises the amino acid G at position 453, numbered according to SEQ ID NO: 138 or 981.

214. The AAV capsid variant of any one of embodiments 203-214, wherein:
(i) position X1 of [N1] is G, A, K, W, R, L, I, M, N, T, E, Q, Y, H, F, or V;
(ii) position X2 of [N1] is H, Y, R, Q, N, P, or D;
(iii) position X3 of [N1] is D, E, G, V, or N;
optionally wherein the AAV capsid variant comprises an amino acid modification, e.g., a conservative substitution, of any of the aforesaid amino acids in (i), (ii), or (iii).

215. The AAV capsid variant of any one of embodiments 203-214, wherein position X2 of [N1] is H and position X3 of [N1] is D.

216. The AAV capsid variant of any one of embodiments 203-215, wherein position X1 of [N1] is G, position X2 of [N1] is H and position X3 of [N1] is D.

217. The AAV capsid variant of any one of embodiments 203-216, wherein [N1] comprises GH, HD, GY, GR, GQ, AH, GN, KH, GP, WH, RH, LH, IH, MH, GD, NH, TH, EH, QH, YH, HH, FH, VH, YD, HE, RG, QD, RD, ND, PD, QV, DD, HN, or NG 218. The AAV capsid variant of any one of embodiments 203-217, wherein [N1] is or comprises GHD, GYD, GHE, GRG, GQD, GRD, AHD, GND, KHD, GPD, WHD, RHD, LHD, GQV, IHD, MHD, GDD, GHN, NHD, THD, GNG, EHD, QHD, YHD, HHD, FHD, or VHD.

219. The AAV capsid variant of any one of embodiments 203-218, wherein [N1] is or comprises GHD.

220. The AAV capsid variant of any one of embodiments 203-219, wherein [N1]-[N2] comprises HDSPH (SEQ ID NO: 4703).

221. The AAV capsid variant of any one of embodiments 203-220, wherein [N1]-[N2] is or comprises:

(i)

| | |
|---|---|
| GHDSPH, | (SEQ ID NO: 4784) |
| GYDSPH, | (SEQ ID NO: 4829) |
| GHESPH, | (SEQ ID NO: 4793) |
| GRGSPH, | (SEQ ID NO: 4788) |
| GHDNPH, | (SEQ ID NO: 5664) |
| GQDSPH, | (SEQ ID NO: 4785) |
| GRDSPH, | (SEQ ID NO: 4831) |
| AHDSPH, | (SEQ ID NO: 5665) |
| GNDSPH, | (SEQ ID NO: 4832) |
| KHDSPH, | (SEQ ID NO: 5666) |
| GPDSPH, | (SEQ ID NO: 4833) |
| WHDSPH, | (SEQ ID NO: 5667) |

RHDSPH, (SEQ ID NO: 5668)

LHDSPH, (SEQ ID NO: 5669)

GQVSPH, (SEQ ID NO: 4835)

IHDSPH, (SEQ ID NO: 5670)

MHDSPH, (SEQ ID NO: 5671)

GDDSPH, (SEQ ID NO: 4792)

GHNSPH, (SEQ ID NO: 4836)

NHDSPH, (SEQ ID NO: 5672)

THDSPH, (SEQ ID NO: 5673)

GNGSPH, (SEQ ID NO: 4805)

EHDSPH, (SEQ ID NO: 5674)

QHDSPH, (SEQ ID NO: 5675)

YHDSPH, (SEQ ID NO: 5676)

HHDSPH, (SEQ ID NO: 5677)

FHDSPH, or (SEQ ID NO: 5678)

VHDSPH; (SEQ ID NO: 5679)

(ii) an amino acid sequence comprising any portion of an amino acid sequence in (i), e.g., any 2, 3, 4, or 5 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

222. The AAV capsid variant of any one of embodiments 203-221, wherein [N1]-[N2]-[N3] is or comprises:

(i)
GHDSPHKSG, (SEQ ID NO: 4698)

GHDSPHKIG, (SEQ ID NO: 4996)

GYDSPHKSG, (SEQ ID NO: 4997)

GHESPHKSG, (SEQ ID NO: 4998)

GHDSPHKTG, (SEQ ID NO: 4999)

GRGSPHKRG, (SEQ ID NO: 5000)

GHDNPHKSG, (SEQ ID NO: 5680)

GQDSPHKSG, (SEQ ID NO: 4908)

GHDSPHKSA, (SEQ ID NO: 4940)

GHDSPHKSL, (SEQ ID NO: 5001)

GHDSPHKSE, (SEQ ID NO: 5003)

GRDSPHKSG, (SEQ ID NO: 5004)

AHDSPHKSG, (SEQ ID NO: 5681)

GNDSPHKSV, (SEQ ID NO: 5005)

AHDSPHKIG, (SEQ ID NO: 5682)

GHESPHKSA, (SEQ ID NO: 4939)

GQDSPHKIG, (SEQ ID NO: 5006)

GHDSPHKSV, (SEQ ID NO: 5007)

GHDSPHKSR, (SEQ ID NO: 4942)

KHDSPHKSG, (SEQ ID NO: 5683)

GPDSPHKIG, (SEQ ID NO: 5008)

GPDSPHKSG, (SEQ ID NO: 5009)

GHDSPHKSW, (SEQ ID NO: 5010)

WHDSPHKSG, (SEQ ID NO: 5684)

RHDSPHKSG, (SEQ ID NO: 5685)

GHDSPHKSN, (SEQ ID NO: 5011)

GHDSPHKRG, (SEQ ID NO: 4937)

GHDSPHKHG, (SEQ ID NO: 5013)

LHDSPHKSG, (SEQ ID NO: 5686)

GQVSPHKSG, (SEQ ID NO: 5014)

IHDSPHKSG, (SEQ ID NO: 5687)

```
                              (SEQ ID NO: 5688)
MHDSPHKSG, (SEQ ID NO: 5015)
GDDSPHKSV, (SEQ ID NO: 5016)
GHNSPHKSG, (SEQ ID NO: 5689)
NHDSPHKSG, (SEQ ID NO: 5690)
THDSPHKSG, (SEQ ID NO: 5017)
GNGSPHKRG, (SEQ ID NO: 5691)
EHDSPHKSG, (SEQ ID NO: 5018)
GHDSPHKYG, (SEQ ID NO: 5019)
GHDSPHKSQ, (SEQ ID NO: 5692)
QHDSPHKSG, (SEQ ID NO: 5693)
RHDSPHKIV, (SEQ ID NO: 5694)
YHDSPHKSG, (SEQ ID NO: 5020)
GNDSPHKIG, (SEQ ID NO: 5695)
HHDSPHKSG, (SEQ ID NO: 5021)
GHDSPHKSK, (SEQ ID NO: 5696)
FHDSPHKSG, (SEQ ID NO: 5022)
GHDSPHKLW, (SEQ ID NO: 5697)
VHDSPHKSG, (SEQ ID NO: 5024)
GHDSPHKMG, (SEQ ID NO: 5025)
GHDSPHKMA,
or
                              (SEQ ID NO: 4938)
GDDSPHKSG;
```

(ii) an amino acid sequence comprising any portion of an amino acid sequence in (i), e.g., any 2, 3, 4, 5, 6, 7, 8, or 9 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

223. The AAV capsid variant of any one of embodiments 203-222, wherein [N1]-[N2]-[N3] is or comprises GHDSPHKSG (SEQ ID NO: 4698).

224. The AAV capsid variant of any one of embodiments 203-223, which comprises an amino acid other than Q at position 456 (e.g., R, P, H, K, L, V, A, E, or I), an amino acid other than N at position 457 (e.g., I, K, S, H, R, T, D, Y, L, W, F, A, Q, or M), an amino acid other than Q at position 458 (e.g., R, V, K, P, Y, H, L, I, E, or M), an amino acid other than Q at position 459 (e.g., H, L, E, P, W, D, I, V, S, K, R, C, M, or N), and/or an amino acid other than T at position 460 (e.g., A, E, K, S, I, P, G, or N), relative to a reference sequence numbered according to SEQ ID NO: 138.

225. The AAV capsid variant of any one of embodiments 203-224, which comprises an amino acid other than Q at position 462 (e.g., R, P, H, K, L, V, A, E, or I), an amino acid other than N at position 463 (e.g., I, K, S, H, R, T, D, Y, L, W, F, A, Q, or M), an amino acid other than Q at position 464 (e.g., R, V, K, P, Y, H, L, I, E, or M), an amino acid other than Q at position 465 (e.g., H, L, E, P, W, D, I, V, S, K, R, C, M, or N), and/or an amino acid other than T at position 466 (e.g., A, E, K, S, I, P, G, or N), relative to a reference sequence numbered according to SEQ ID NO: 982.

226. The AAV capsid variant of any one of embodiments 203-225, which comprises the amino acid Q at position 456, the amino acid N at position 457, the amino acid Q at position 458, the amino acid Q at position 459, and/or the amino acid T at position 460, relative to a reference sequence numbered according to SEQ ID NO: 138.

227. The AAV capsid variant of any one of embodiments 203-226, which comprises the amino acid Q at position 462, the amino acid N at position 463, the amino acid Q at position 464, the amino acid Q at position 465, and/or the amino acid T at position 466, relative to a reference sequence numbered according to SEQ ID NO: 138.

228. The AAV capsid variant of any one of embodiments 203-227, further comprising [N4] wherein [N4] comprises X7, X8, X9, X10, and X11, wherein:
(a) X7 is Q, R, P, H, L, K, I, G, S, M, or E;
(b) X8 is N, D, V, S, P, T, G, Y, W, E, R, H, K, F, A, I, L, or M;
(c) X9 is Q, R, L, A, P, H, T, I, F, K, V, M, G, W, Y, S, E, N, D;
(d) X10 is Q, H, K, A, L, P, E, M, I, S, N, R, Y, C, V, T, W, D, G; and
(e) X11 is T, I, N, S, H, R, L, D, Y, A, Q;
optionally wherein the AAV capsid variant comprises an amino acid modification, e.g., a conservative substitution, of any of the aforesaid amino acids in (a)-(e).

229. The AAV capsid variant of embodiment 228, wherein [N4] is or comprises:

```
(i)
                              (SEQ ID NO: 5412)
QNQQT, (SEQ ID NO: 5698)
QIRQT, (SEQ ID NO: 5699)
QNQHA, (SEQ ID NO: 5543)
QKQQT,
```

QSVQT, (SEQ ID NO: 5700)

RSQQT, (SEQ ID NO: 5701)

QNKLE, (SEQ ID NO: 5702)

QNQQK, (SEQ ID NO: 5703)

QHQQA, (SEQ ID NO: 5704)

QIQHT, (SEQ ID NO: 5705)

PRQQT, (SEQ ID NO: 5706)

HTQQT, (SEQ ID NO: 5707)

QRQHT, (SEQ ID NO: 5708)

QSQQT, (SEQ ID NO: 5418)

QNQQS, (SEQ ID NO: 5709)

RNQET, (SEQ ID NO: 5710)

QTQLT, (SEQ ID NO: 5478)

KNQQT, (SEQ ID NO: 5711)

QDQQT, (SEQ ID NO: 5432)

HNQQT, (SEQ ID NO: 5426)

QNQLT, (SEQ ID NO: 5423)

QTQQT, (SEQ ID NO: 5712)

QTQQI, (SEQ ID NO: 5713)

QSKQA, (SEQ ID NO: 5714)

QNQPP, (SEQ ID NO: 5715)

QSPQT, (SEQ ID NO: 5716)

QNYQT, (SEQ ID NO: 5493)

QNHQT, (SEQ ID NO: 5431)

QNRQT, (SEQ ID NO: 5446)

QNQQG, (SEQ ID NO: 5717)

QNHLT, (SEQ ID NO: 5482)

QYQHT, (SEQ ID NO: 5447)

QNQWT, (SEQ ID NO: 5503)

QNQHT, (SEQ ID NO: 5718)

QTRQT, (SEQ ID NO: 5719)

QNLHT, (SEQ ID NO: 5720)

LNQQT, (SEQ ID NO: 5471)

QNQET, (SEQ ID NO: 5721)

QHLQT, (SEQ ID NO: 5513)

LNQPT, (SEQ ID NO: 5722)

QNQDT, (SEQ ID NO: 5723)

RNQQT, (SEQ ID NO: 5724)

QNLLT, (SEQ ID NO: 5725)

QLVIT, (SEQ ID NO: 5726)

RTQET, (SEQ ID NO: 5727)

QTHQT, (SEQ ID NO: 5728)

QNQPA, (SEQ ID NO: 5729)

QDQHT, (SEQ ID NO: 5730)

QSQHT, (SEQ ID NO: 5731)

RNQQI, (SEQ ID NO: 5732)

VRQQT, (SEQ ID NO: 5733)

QNQHS, (SEQ ID NO: 5734)

AWQQT, (SEQ ID NO: 5735)

QSVPT, (SEQ ID NO: 5736)

QNIQP, (SEQ ID NO: 5737)

QNHLN, (SEQ ID NO: 5738)

LDQQT, (SEQ ID NO: 5739)

PDQQS, (SEQ ID NO: 5740)

ESQQT, (SEQ ID NO: 5741)

QNKQT, (SEQ ID NO: 5742)

QRQLT, (SEQ ID NO: 5743)

QIIVT, (SEQ ID NO: 5744)

QKQST, (SEQ ID NO: 5745)

QSHQT, (SEQ ID NO: 5746)

QFVVT, (SEQ ID NO: 5747)

QNLQT, (SEQ ID NO: 5428)

QNQQI, (SEQ ID NO: 5419)

QSQPT, (SEQ ID NO: 5748)

QNEQT, (SEQ ID NO: 5749)

QSLQT, (SEQ ID NO: 5516)

RNRQT, (SEQ ID NO: 5750)

QSKQT, (SEQ ID NO: 5751)

QNPLT, (SEQ ID NO: 5752)

RDQKT, (SEQ ID NO: 5753)

HNQQN, (SEQ ID NO: 5754)

QWKRT, (SEQ ID NO: 5755)

QSQQI, (SEQ ID NO: 5476)

QAQQT, (SEQ ID NO: 5462)

QNHQI, (SEQ ID NO: 5756)

QNQQA, (SEQ ID NO: 5757)

QNQLN, (SEQ ID NO: 5758)

QTQPT, (SEQ ID NO: 5759)

INQQT, (SEQ ID NO: 5560)

QKQLT, (SEQ ID NO: 5760)

RNQLA, (SEQ ID NO: 5761)

RNQQS, (SEQ ID NO: 5762)

ISIQT, (SEQ ID NO: 5763)

QNQQN, (SEQ ID NO: 5764)

QSQQS, (SEQ ID NO: 5765)

QTVCT, (SEQ ID NO: 5766)

QYQQI, (SEQ ID NO: 5767)

QQIMT, (SEQ ID NO: 5768)

QNEQS, (SEQ ID NO: 5769)

LNHQT, (SEQ ID NO: 5770)

QMIHT, (SEQ ID NO: 5771)

RNHQS, (SEQ ID NO: 5772)

QKMNT, (SEQ ID NO: 5773)

QSQQN, (SEQ ID NO: 5774)

QYQHA; (SEQ ID NO: 5465)

(ii) an amino acid sequence comprising any portion of an amino acid sequence in (i), e.g., any 2, 3, or 4 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

230. The AAV capsid variant of embodiment 228 or 229, wherein [N1]-[N2]-[N3]-[N4] is or comprises:

(i) the amino acid sequence of any of SEQ ID NOs: 201 or 3160-3237;

(ii) an amino acid sequence comprising any portion of an amino acid sequence in (i), e.g., any 2, 3, 4, 5, 6, 7, 8, 9, 10, 11, 12, or 13 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

231. The AAV capsid variant of any one of embodiments 228-230, wherein [N1]-[N2]-[N3]-[N4] is or comprises GHDSPHKSGQNQQT (SEQ ID NO: 201).

232. The AAV capsid variant of any one of embodiments 203-231, which comprises an amino acid other than K at position 449 (e.g., T), T at position 450 (e.g., A, S, I, V, N, E, Y, C, G, W, or Q), an amino acid other than I at position 451 (e.g., E, V, S, T, N, D, C, G, Q, L, P, A), and/or an amino acid other than N at position 452 (e.g., S, Y, I, K, F, T, D, E, G, V, L, A, M, Q, H, P, or R), relative to a reference sequence numbered according to SEQ ID NO: 138 or 982.

233. The AAV capsid variant of any one of embodiments 203-232, which comprises the amino acid K at position 449, the amino acid T at position 450, the amino acid I at position 451, and/or the amino acid N at position 452, relative to a reference sequence numbered according to SEQ ID NO: 138 or 982.

234. The AAV capsid variant of any one of embodiments 203-233, which further comprises [N0], wherein [N0] comprises $X_A$, $X_B$, $X_C$, and $X_D$, wherein:
(a) $X_A$ is K or T;
(b) $X_b$ is T, A, S, I, V, N, E, Y, C, G, W, or Q;
(c) $X_C$ is I, E, V, S, T, N, D, C, G, Q, L, P, A; and
(d) $X_D$ is N, S, Y, I, K, F, T, D, E, G, V, L, A, M, Q, H, P, or R;
optionally wherein the AAV capsid variant comprises an amino acid modification, e.g., a conservative substitution, of any of the aforesaid amino acids in (a)-(d).

235. The AAV capsid variant of embodiment 234, wherein [N0] is or comprises:

(i)
KAIN, (SEQ ID NO: 5575)
KTIN, (SEQ ID NO: 5570)
KTES, (SEQ ID NO: 5601)
TTIN, (SEQ ID NO: 5571)
KSIN, (SEQ ID NO: 5572)
KTVN, (SEQ ID NO: 5568)
KSIY, (SEQ ID NO: 5775)
KTSN, (SEQ ID NO: 5578)
KTTN, (SEQ ID NO: 5602)
KIIN, (SEQ ID NO: 5776)
KTIS, (SEQ ID NO: 5606)
KAII, (SEQ ID NO: 5777)
KTIK, (SEQ ID NO: 5612)
KTEF, (SEQ ID NO: 5624)
KTIT, (SEQ ID NO: 5620)
KTNN, (SEQ ID NO: 5604)
KTID, (SEQ ID NO: 5592)
KAIS, (SEQ ID NO: 5778)
KTVD, (SEQ ID NO: 5779)
KTIE, (SEQ ID NO: 5780)
KTEG, (SEQ ID NO: 5647)
KVIN, (SEQ ID NO: 5623)
KAVN, (SEQ ID NO: 5645)
KTIY, (SEQ ID NO: 5781)
KTDN, (SEQ ID NO: 5576)
KTCN, (SEQ ID NO: 5583)
KNVV, (SEQ ID NO: 5782)
KTEL, (SEQ ID NO: 5595)
KTDA, (SEQ ID NO: 5783)
KTEV, (SEQ ID NO: 5644)
KSEL, (SEQ ID NO: 5642)
KTEM, (SEQ ID NO: 5784)
KTEQ, (SEQ ID NO: 5632)
KTII, (SEQ ID NO: 5565)
KIVN, (SEQ ID NO: 5785)
KTEK, (SEQ ID NO: 5567)
KTEN, (SEQ ID NO: 5581)
KIGN, (SEQ ID NO: 5786)
KEVM, (SEQ ID NO: 5787)
KYQV, (SEQ ID NO: 5788)
KTEA, (SEQ ID NO: 5597)
KATN, (SEQ ID NO: 5586)

KTEH, (SEQ ID NO: 5584)
KTVE, (SEQ ID NO: 5789)
KAID, (SEQ ID NO: 5790)
KTIM, (SEQ ID NO: 5791)
KEVG, (SEQ ID NO: 5792)
KSEM, (SEQ ID NO: 5793)
KAQQ, (SEQ ID NO: 5794)
KCGE, (SEQ ID NO: 5795)
KASN, (SEQ ID NO: 5796)
KTET, (SEQ ID NO: 5594)
KTIG, (SEQ ID NO: 5797)
KTDP, (SEQ ID NO: 5798)
KELV, (SEQ ID NO: 5799)
KELM, (SEQ ID NO: 5800)
KNEI, (SEQ ID NO: 5801)
KTPN, (SEQ ID NO: 5802)
KITN, (SEQ ID NO: 5803)
KTDI, (SEQ ID NO: 5804)
KTDQ, (SEQ ID NO: 5805)
KGIN, (SEQ ID NO: 5806)
KSEI, (SEQ ID NO: 5807)
KSEK, (SEQ ID NO: 5627)
KWSA, (SEQ ID NO: 5808)
KELA, (SEQ ID NO: 5809)
KQTQ, (SEQ ID NO: 5810)
KGAD, (SEQ ID NO: 5811)
KVGE, (SEQ ID NO: 5812)
KANE, (SEQ ID NO: 5813)
KTDT, (SEQ ID NO: 5814)
KTCI, (SEQ ID NO: 5815)
KELR, (SEQ ID NO: 5816)
KCQI, (SEQ ID NO: 5817)
KGVM, (SEQ ID NO: 5818)
KACD, (SEQ ID NO: 5819)
KNEL, (SEQ ID NO: 5820)
KAAE, (SEQ ID NO: 5821)
KGQN, (SEQ ID NO: 5822)
KNEF, (SEQ ID NO: 5823)
KTSI, (SEQ ID NO: 5824)
KAEH, (SEQ ID NO: 5616)
KCDQ, (SEQ ID NO: 5825)
KEIL, (SEQ ID NO: 5826)
KTER, (SEQ ID NO: 5573)
KNAI, (SEQ ID NO: 5650)
KTDK, (SEQ ID NO: 5588)
KTPD, (SEQ ID NO: 5827)
KTIH, (SEQ ID NO: 5659)
or
KTEI; (SEQ ID NO: 5591)

(ii) an amino acid sequence comprising any portion of an amino acid sequence in (i), e.g., any 2, or 3 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

236. The AAV capsid variant of embodiment 234 or 235, wherein [N0]-[N1]-[N2]-[N3]-[N4] is or comprises:

(i) the amino acid sequence of any one of SEQ ID NOs: 3606-3836;

(ii) an amino acid sequence comprising any portion of an amino acid sequence in (i), e.g., any 2, 3, 4, 5, 6, 7, 8, 9, 10, 11, 12, 13, 14, 15, 16, or 17 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

237. The AAV capsid variant of any one of embodiments 234-236, wherein [N0]-[N1]-[N2]-[N3]-[N4] is or comprises KTINGHDSPHKSGQNQQT (SEQ ID NO: 5828).

238. The AAV capsid variant of any one of embodiments 234-236, wherein [N0]-[N1]-[N2]-[N3]-[N4] is or comprises KAEIGHDSPHKSGQNQQT (SEQ ID NO: 1754).

239. The AAV capsid variant of any one of embodiments 234-236, wherein [N0]-[N1]-[N2]-[N3]-[N4] is or comprises KTEKMSGSPHSKAQNQQT (SEQ ID NO: 3241).

240. The AAV capsid variant of any one of embodiments 168-239, wherein [N1]-[N2]-[N3] is present in loop IV.

241. The AAV capsid variant of any one of embodiments 198-202 or 234-240, wherein [N0] and [N4] are present in loop IV.

242. The AAV capsid variant of any one of embodiments 198-202 or 234-241, wherein [N0] is present immediately subsequent to position 448, relative to a reference sequence numbered according to the amino acid sequence of SEQ ID NO: 138, 981, or 982.

243. The AAV capsid variant of any one of embodiments 198-202 or 234-242, wherein [N0] replaces positions 449-452 (e.g., K449, T450, I451, and N452), relative to a reference sequence numbered according to SEQ ID NO: 138, 981, or 982.

244. The AAV capsid variant of any one of embodiments 198-202 or 234-243, wherein [N0] is present immediately subsequent to position 448 and wherein [N0] replaces positions 449-452 (e.g., K449, T450, I451, and N452), relative to a reference sequence numbered according to SEQ ID NO: 138, 981, or 982.

245. The AAV capsid variant of any one of embodiments 198-202 or 234-244, wherein [N0] corresponds to positions 449-452 (e.g., K449, T450, I451, and N452) of any one of SEQ ID NOs: 138, 981, or 982.

246. The AAV capsid variant of any one of embodiments 168-245, wherein [N1] is present immediately subsequent to position 452, relative to a reference sequence numbered according to the amino acid sequence of SEQ ID NO: 138, 981, or 982.

247. The AAV capsid variant of any one of embodiments 168-246, wherein [N1] replaces positions 453-455 (e.g., G453, S454, and G455), relative to a reference sequence numbered according to SEQ ID NO: 138, 981, or 982.

248. The AAV capsid variant of any one of embodiments 168-246, wherein [N1] replaces position 453 (e.g., G453), relative to a reference sequence numbered according to SEQ ID NO: 138, 981, or 982.

249. The AAV capsid variant of any one of embodiments 168-177, 179-181, 183-185, 187-193, 195-200, 202, or 240-246, wherein:

(i) position X1 of [N1] replaces position 453 (e.g., G453);

(ii) position X2 of [N1] corresponds to position 454 (e.g., S454); and (iii) position X3 of [N1] corresponds to position 455 (e.g., G455), wherein (i), (ii), and (iii) are numbered according to SEQ ID NO: 138 or SEQ ID NO: 981.

250. The AAV capsid variant of any one of embodiments 168-176, 178-201, or 240-246, wherein:

(i) position X1 of [N1] corresponds to position 453 (e.g., G453);

(ii) position X2 of [N1] corresponds to position 454 (e.g., S454); and (iii) position X3 of [N1] corresponds to position 455 (e.g., G455);

wherein (i), (ii), and (iii) are numbered according to SEQ ID NO: 138 or SEQ ID NO: 981.

251. The AAV capsid variant of any one of embodiments 203-248, wherein:

(i) position X1 of [N1] corresponds to position 453 (e.g., G453);

(ii) position X2 of [N1] replaces position 454 (e.g., S454); and (iii) position X3 of [N1] replaces position 455 (e.g., G455), wherein (i), (ii), and (iii) are numbered according to SEQ ID NO: 138 or SEQ ID NO: 982.

252. The AAV capsid variant of any one of embodiments 203-248 or 251, wherein [N1] corresponds to positions 453-455 (e.g., G453, H454, D455) of SEQ ID NO 982.

253. The AAV capsid variant of any one of embodiments 168-176, 178-201, 240-247, or 250, wherein [N1] corresponds to positions 453-455 (e.g., G453, S454, G455) of SEQ ID NO: 138, or 981.

254. The AAV capsid variant of any one of embodiments 168-253, wherein [N2] is present immediately subsequent to position 455, relative to a reference sequence numbered according to the amino acid sequence of SEQ ID NO: 138, 981, or 982.

255. The AAV capsid variant of any one of embodiments 168-254, wherein [N2] corresponds to positions 456-458 (e.g., S456, P457, and H458) of SEQ ID NO: 981 or 982.

256. The AAV capsid variant of any one of embodiments 168-254, wherein [N2] corresponds to positions 456-458 (e.g., S456, P457, and H458) of any one of SEQ ID NOs: 36-59.

257. The AAV capsid variant of any one of embodiments 168-256, wherein [N2] is present immediately subsequent to [N1].

258. The AAV capsid variant of any one of embodiments 168-202, 240-247, 249-257, wherein [N3] corresponds to positions 459-460 (e.g., S459, K460, A461) of SEQ ID NO: 981.

259. The AAV capsid variant of any one of embodiments 168-202, 240-247, 249-257, wherein [N3] corresponds to positions 459-460 (e.g., S459, K460, A461) of SEQ ID NO: 36, 38, 39, 40, 41, 42, 43, 44, 45, 46, 47, 48, 49, 50, 51, 52, 53, 54, 55, 57, or 59.

260. The AAV capsid variant of any one of embodiments 168-259, wherein [N2]-[N3] is present immediately subsequent to position 455, relative to a reference sequence numbered according to the amino acid sequence of any one of SEQ ID NOs: 138, 981, or 982.

261. The AAV capsid variant of any one of embodiments 168-259, wherein [N2]-[N3] is present immediately 262. The AAV capsid variant of any one of embodiments 168-261, wherein [N2]-[N3] corresponds to positions 456-461 (e.g., S456, P457, H458, S459, K460, A461) of SEQ ID NO: 981.
263. The AAV capsid variant of any one of embodiments 168-262, wherein [N2]-[N3] corresponds to positions 456-461 (e.g., S456, P457, H458, S459, K460, A461) of any one of SEQ ID NOs: 36, 38, 39, 40, 41, 42, 43, 44, 45, 46, 47, 48, 49, 50, 51, 52, 53, 54, 55, 57, or 59.
264. The AAV capsid variant of any one of embodiments 203-257 or 259-261, wherein [N3] corresponds to positions 459-460 (e.g., K459, S460, G461) of SEQ ID NO: 982.
265. The AAV capsid variant of any one of embodiments 203-257 or 259-261, wherein [N3] corresponds to positions 459-460 (e.g., K459, S460, G461) of SEQ ID NO: 37.
266. The AAV capsid variant of any one of embodiments 203-265, wherein [N2]-[N3] is present immediately subsequent to position 455, relative to a reference sequence numbered according to the amino acid sequence of SEQ ID NO: 982.
267. The AAV capsid variant of any one of embodiments 203-246, 248, 252, 255, 257, 260, 263-266, wherein [N3] replaces positions 454 and 455 (e.g., S454 and G455), numbered according to SEQ ID NO: 138.
268. The AAV capsid variant of any one of embodiments 203-246, 248, 252, 255, 257, 260, 263-267, wherein [N3] is present immediately subsequent to [N2] and replaces positions 454 and 455 (e.g., S454 and G455), numbered according to SEQ ID NO: 138.
269. The AAV capsid variant of any one of embodiments 203-246, 248, 252, 255, 257, 260, 263-268, wherein [N3] is present immediately subsequent to [N1]-[N2] and replaces positions 454 and 455 (e.g., S454 and G455), numbered according to SEQ ID NO: 138.
270. The AAV capsid variant of any one of embodiments 203-257, 260, 264-269, wherein [N2]-[N3] corresponds to positions 456-461 (e.g., S456, P457, H458, K459, S460, G461) of SEQ ID NO: 982.
271. The AAV capsid variant of any one of embodiments 203-257, 260, 264-270, wherein [N2]-[N3] corresponds to positions 456-461 (e.g., S456, P457, H458, K459, S460, G461) of SEQ ID NO: 37.
272. The AAV capsid variant of any one of embodiments 191-202 or 228-271, wherein [N4] is present immediately subsequent to position 455, relative to a reference sequence numbered according to the amino acid sequence of SEQ ID NO: 138.
273. The AAV capsid variant of any one of embodiments 191-202 or 228-272, wherein [N4] replaces positions 456-460 (e.g., Q456, N457, Q458, Q459, and T460), relative to a reference sequence numbered according to the amino acid sequence of SEQ ID NO: 138.
274. The AAV capsid variant of any one of embodiments 191-202 or 228-273, wherein [N4] corresponds to positions 462-466 (e.g., Q462, N463, Q464, Q465, and T466) of SEQ ID NO: 981 or 982.
275. The AAV capsid variant of any one of embodiments 191-202 or 228-273, wherein [N4] corresponds to positions 462-466 of any one of SEQ ID NOs: 36-59.
276. The AAV capsid variant of any one of embodiments 191-202 or 228-274, wherein [N4] corresponds to positions 456-460 (e.g., Q456, N457, Q458, Q459, and T460) of SEQ ID NO: 138.
277. The AAV capsid variant of any one of embodiments 191-202 or 228-276, wherein [N2]-[N3]-[N4] replaces positions 456-460 (e.g., Q456, N457, Q458, Q459, and T460), relative to a reference sequence numbered according to the amino acid sequence of SEQ ID NO: 138.
278. The AAV capsid variant of any one of embodiments 191-202 or 228-277, wherein [N2]-[N3]-[N4] is present immediately subsequent to position 455, and wherein [N2]-[N3]-[N4] replaces positions 456-460 (e.g., Q456, N457, Q458, Q459, and T460), relative to a reference sequence numbered according to the amino acid sequence of SEQ ID NO: 138.
279. The AAV capsid variant of any one of embodiments 191-202 or 228-278, wherein [N1]-[N2]-[N3]-[N4] replaces positions 453-460 (e.g., G453, S454, G455, Q456, N457, Q458, Q459, and T460), relative to a reference sequence numbered according to the amino acid sequence of SEQ ID NO: 138.
280. The AAV capsid variant of any one of embodiments 191-202 or 228-279, wherein [N1]-[N2]-[N3]-[N4] is present immediately subsequent to position 452, and wherein [N1]-[N2]-[N3]-[N4] replaces positions 453-460 (e.g., G453, S454, G455, Q456, N457, Q458, Q459, and T460), relative to a reference sequence numbered according to the amino acid sequence of SEQ ID NO: 138.
281. The AAV capsid variant of any one of embodiments 191-202, 240-247, 249, 250, 253-263, 266, or 272-280, wherein [N1]-[N2]-[N3]-[N4] corresponds to positions 453-466 (e.g., G453, S454, G455, S456, P457, H458, S459, K460, A461, Q462, N463, Q464, Q465, and T466) of SEQ ID NO: 981.
282. The AAV capsid variant of any one of embodiments 168-202, 240-247, 249, 250, 253-263, 266, or 272-280, wherein [N1]-[N2]-[N3] corresponds to positions 453-461 (e.g., G453, S454, G455, S456, P457, H458, S459, K460, A461) of SEQ ID NO: 981.
283. The AAV capsid variant of any one of embodiments 228-257, 260, 261, 264-282, wherein [N1]-[N2]-[N3]-[N4] corresponds to positions 453-466 (e.g., G453, H454, D455, S456, P457, H458, K459, S460, G461, Q462, N463, Q464, Q465, T466) of SEQ ID NO: 982.
284. The AAV capsid variant of any one of embodiments 203-257, 260, 261, 264-283, wherein [N1]-[N2]-[N3] corresponds to positions 453-461 (e.g., G453, H454, D455, S456, P457, H458, K459, S460, G461) of SEQ ID NO: 982.
285. The AAV capsid variant of any one of embodiments 228-257, 260, 261, 264-282, wherein [N1]-[N2]-[N3]-[N4] corresponds to positions 453-466 of any one of SEQ ID NOs: 36-59.
286. The AAV capsid variant of any one of embodiments 198-202 or 234-286, wherein [N0]-[N1]-[N2]-[N3]-[N4] replaces positions 449-460 (e.g., K449, T450, 1451, N452, G453, 5454, G455, Q456, N457, Q458, Q459, and T460), relative to a reference sequence numbered according to the amino acid sequence of SEQ ID NO: 138.
287. The AAV capsid variant of any one of embodiments 198-202 or 234-286, wherein [N0]-[N1]-[N2]-[N3]-[N4] is present immediately subsequent to position 449, and wherein [N0]-[N1]-[N2]-[N3]-[N4] replaces positions 449-460 (e.g., K449, T450, 1451, N452, G453, S454, G455, Q456, N457, Q458, Q459, and T460), relative to a reference sequence numbered according to the amino acid sequence of SEQ ID NO: 138.

288. The AAV capsid variant of any one of embodiments 198-202, 240-247, 249, 250, 253-263, 266, 272-281, 286, or 287, wherein [N0]-[N1]-[N2]-[N3]-[N4] corresponds to positions 449-466 (e.g., K449, T450, I451, N452, G453, S454, G455, S456, P457, H458, S459, K460, A461, Q462, N463, Q464, Q465, T466) of SEQ ID NO: 981.

289. The AAV capsid variant of any one of embodiments 234-257, 260, 261, 264-284, 286, or 287, wherein [N0]-[N1]-[N2]-[N3]-[N4] corresponds to positions 449-466 (e.g., K449, T450, I451, N452, G453, H454, D455, S456, P457, H458, K459, S460, G461, Q462, N463, Q464, Q465, T466) of SEQ ID NO: 982.

290. The AAV capsid variant of any one of embodiments 234-257, 260, 261, 264-284, 286, or 287, wherein [N0]-[N1]-[N2]-[N3]-[N4] corresponds to positions 449-466 of any one of SEQ ID NOs: 36-59.

291. The AAV capsid variant of any one of embodiments 191-202 or 228-290, wherein [N4] is present immediately subsequent to position 461, relative to a reference sequence numbered according to the amino acid sequence of SEQ ID NO: 981 or 982.

292. The AAV capsid variant of any one of embodiments 191-202 or 228-291, wherein [N4] replaces positions 462-466 (e.g., Q462, N463, Q464, Q465, and T466), relative to a reference sequence numbered according to the amino acid sequence of SEQ ID NO: 981 or 982.

293. The AAV capsid variant of any one of embodiments 191-202 or 228-292, wherein [N2]-[N3]-[N4] replaces positions 462-466 (e.g., Q462, N463, Q464, Q465, and T466), relative to a reference sequence numbered according to the amino acid sequence of SEQ ID NO: 981 or 982.

294. The AAV capsid variant of any one of embodiments 191-202 or 228-293, wherein [N2]-[N3]-[N4] is present immediately subsequent to position 455, and wherein [N2]-[N3]-[N4] replaces positions 462-466 (e.g., Q462, N463, Q464, Q465, and T466), relative to a reference sequence numbered according to the amino acid sequence of SEQ ID NO: 981 or 982.

295. The AAV capsid variant of any one of embodiments 168-294, which comprises from N-terminus to C-terminus, [N2]-[N3].

296. The AAV capsid variant of any one of embodiments 168-295, which comprises from N-terminus to C-terminus, [N1]-[N2]-[N3].

297. The AAV capsid variant of any one of embodiments 168-296, which comprises from N-terminus to C-terminus, [N0]-[N1]-[N2]-[N3].

298. The AAV capsid variant of any one of embodiments 168-297, which comprises from N-terminus to C-terminus, [N1]-[N2]-[N3]-[N4].

299. The AAV capsid variant of any one of embodiments 168-298, which comprises from N-terminus to C-terminus, [N0]-[N1]-[N2]-[N3]-[N4].

300. An AAV capsid variant comprising the formula [A]-[B] (SEQ ID NO: 4696), wherein:
   (i) [A] comprises GSGSPH (SEQ ID NO: 4695); and
   (ii) [B] comprises X1 X2, X3, X4, and X5, wherein:
      (a) position X1 is S, I, F, V, C, Y, W, R, P, L, Q, M, K, or G;
      (b) position X2 is K, M, R, F, V, C, P, Y, L, W, G, N, S, T, I, or A;
      (c) position X3 is A, Y, L, R, W, C, T, F, H, I, P, M, K, S, V, G, Q, or N;
      (d) position X4 is Q, M, F, K, H, R, C, W, P, V, L, G, S, Y, I, A, T, D, N, or E; and
      (e) position X5 is A, N, Y, R, K, L, I, M, Q, S, C, W, F, T, G, V, or P;
   optionally wherein the AAV capsid variant comprises an amino acid modification, e.g., a conservative substitution, of any of the aforesaid amino acids in (a)-(e).

301. The AAV capsid variant of embodiment 300, wherein:
   (a) position X1 is S, L, R, V, or P;
   (b) position X2 is K, C, F, L, P, R, S, or V;
   (c) position X3 is A, C, F, I, K, L, M, P, R, T, W, or Y;
   (d) position X4 is Q, R, S, T, C, F, K, L, P or Y; and
   (e) position X5 is N, R, S, T, K, M, Q or Y;
   optionally wherein the AAV capsid variant comprises an amino acid modification, e.g., a conservative substitution, of any of the aforesaid amino acids in (a)-(e).

302. The AAV capsid variant of embodiment 300 or 301, wherein [B] comprises SKA, SMY, SKL, SKR, SKW, SRC, SFT, SKF, IVW, SKY, SCH, FPW, SKI, VYY, SLY, SKP, SRF, SRM, SVK, SWA, SLW, SFR, SKK, SYA, SCS, SGA, SFP, SFF, SMC, SKT, SGK, FYR, CRV, YGI, VNC, SLA, WSY, RWL, PSC, SSW, SKG, VPW, SGC, STT, PKR, SKC, WVP, SFW, RIK, SKM, LRW, LPT, SYM, LLC, RCC, LCV, SYL, QGC, MAF, SFQ, SLC, RPW, RPR, SCP, SVR, SLP, VYH, SYT, LVY, YRY, SWL, CPA, SPP, RWT, PRK, PFV, SKS, WVA, SKV, CAL, SSC, SKN, LCT, STC, SKQ, KSG, SYY, SLT, SCQ, FPF, SVF, GRY, AQA, AQN, YMN, AFY, LKR, RHR, AQK, WRL, CRN, TCN, FFI, AQY, WQN, YFM, ARQ, HQN, IRR, YQN, YWN, AFS, FWN, AQC, MRN, KKN, APN, WKN, ARW, RPN, KVF, AFN, ACS, RLW, SRN, CPN, ACN, FRQ, PFN, FGN, CQN, LFW, TRK, KRN, RQN, VQN, IQN, AQR, PFR, AWN, RSY, LQN, WLN, RRA, AQT, GCT, RYT, TPN, ARM, CFL, PQN, WSN, FKN, KQN, APR, RYN, MIC, TQN, WKS, AAR, LTR, IRG, LVN, FQN, ACQ, WGL, ILR, QIN, ACI, ALR, AHA, CLN, AFV, AQF, RCN, MPC, KTS, PYN, AQS, TRN, LKN, AQM, CTN, PDN, RNY, ACR, CSV, ARI, LPK, SEQ, VRM, NSR, RKR, ARN, QRP, RVV, GQN, YSN, QSN, AKG, CTS, FEN, AKK, KAQ, MYM, KAF, KLK, KRH, KWR, RCR, FTC, KFF, VWQ, KYF, KAR, CHQ, PWQ, KIR, YYQ, LYW, KPK, RFW, RMR, VKK, WAP, LWK, FRP, KKV, YAF, KAC, KRL, CSR, RCP, GAC, KFR, FFG, MCQ, KLF, KTR, GKR, YRQ, RVQ, GIQ, NCQ, KPF, LAW, KRS, SYQ, WLQ, KRR, KGC, KRY, GCQ, FTP, TTC, KRQ, KCF, VPQ, FWS, KFK, IKQ, KAP, FRY, KMI, RWQ, PTQ, KWK, YMR, KAA, LCQ, CCQ, CVQ, KLT, KLC, YLV, AFQ, KWG, KIL, FQI, KAL, KAH, LCL, PRQ, CPQ, VRY, VRC, KMP, KKT, LPY, YHQ, YTR, VYQ, RYQ, WLK, PAQ, MCT, PPD, WTQ, RKQ, KCS, FVQ, KLP, KSE, VAQ, LYQ, KVR, ALQ, SCT, KNS, KRK, CTQ, TCL, YAR, KQR, KRV, SGQ, YYS, LTC, CQS, KAK, KPQ, PFQ, KCT, or VFE.

303. The AAV capsid variant of any one of embodiments 300-302, wherein [B] comprises SKAQ (SEQ ID NO: 5829), SMYM (SEQ ID NO: 5830), SKAF (SEQ ID NO: 5831), SKLK (SEQ ID NO: 5832), SKRH (SEQ ID NO: 5833), SKWR (SEQ ID NO: 5834), SRCR (SEQ ID NO: 5835), SFTC (SEQ ID NO: 5836), SKFF (SEQ ID NO: 5837), IVWQ (SEQ ID NO: 5838), SKYF (SEQ ID NO: 5839), SKAR (SEQ ID NO: 5840), SCHQ (SEQ ID NO: 5841), FPWQ (SEQ ID NO: 5842), SKIR (SEQ ID NO: 5843), VYYQ (SEQ ID NO: 5844), SLYW (SEQ ID NO: 5845), SKPK (SEQ ID NO: 5846), SRFW (SEQ ID NO: 5847), SRMR (SEQ ID NO: 5848), SVKK (SEQ ID NO: 5849), SWAP (SEQ ID NO: 5850), SLWK (SEQ ID NO: 5851), SFRP (SEQ ID NO: 5852), SKKV (SEQ ID NO: 5853), SYAF (SEQ ID NO: 5854), SKAC (SEQ ID NO: 5855), SKRL (SEQ ID NO: 5856), SCSR (SEQ ID NO: 5857), SRCP (SEQ ID NO: 5858), SGAC (SEQ ID NO: 5859), SKFR (SEQ ID NO: 5860), SFPF (SEQ ID NO: 5861), SFFG (SEQ ID NO: 5862), SMCQ (SEQ ID NO: 5863), SKLF (SEQ ID NO: 5864), SKTR (SEQ ID NO: 5865), SGKR (SEQ ID NO: 5866), FYRQ (SEQ ID NO: 5867), CRVQ (SEQ ID NO: 5868), YGIQ (SEQ ID NO: 5869), VNCQ (SEQ ID NO: 5870), SKPF (SEQ ID NO: 5871), SLAW (SEQ ID NO: 5872), SKRS (SEQ ID NO: 5873), WSYQ (SEQ ID NO: 5874), RWLQ (SEQ ID NO: 5875), PSCQ (SEQ ID NO: 5876), SSWL (SEQ ID NO: 5877), SKRR (SEQ ID NO: 5878), SKGC (SEQ ID NO: 5879), VPWQ (SEQ ID NO: 5880), SKRY (SEQ ID NO: 5881), SGCQ (SEQ ID NO: 5882), SFTP (SEQ ID NO: 5883), STTC (SEQ ID NO: 5884), PKRQ (SEQ ID NO: 5885), SKCF (SEQ ID NO: 5886), WVPQ (SEQ ID NO: 5887), SFWS (SEQ ID NO: 5888), SKFK (SEQ ID NO: 5889), RIKQ (SEQ ID NO: 5890), SKAP (SEQ ID NO: 5891), SFRY (SEQ ID NO: 5892), SKMI (SEQ ID NO: 5893), LRWQ (SEQ ID NO: 5894), LPTQ (SEQ ID NO: 5895), SKWK (SEQ ID NO: 5896), SYMR (SEQ ID NO: 5897), SKAA (SEQ ID NO: 5898), LLCQ (SEQ ID NO: 5899), RCCQ (SEQ ID NO: 5900), LCVQ (SEQ ID NO: 5901), SKLT (SEQ ID NO: 5902), SKLC (SEQ ID NO: 5903), SYLV (SEQ ID NO: 5904), QGCQ (SEQ ID NO: 5905), MAFQ (SEQ ID NO: 5906), SKWG (SEQ ID NO: 5907), SKIL (SEQ ID NO: 5908), SFQI (SEQ ID NO: 5909), SKAL (SEQ ID NO: 5910), SKAH (SEQ ID NO: 5911), SLCL (SEQ ID NO: 5912), RPWQ (SEQ ID NO: 5913), RPRQ (SEQ ID NO: 5914), SCPQ (SEQ ID NO: 5915), SVRY (SEQ ID NO: 5916), SVRC (SEQ ID NO: 5917), SKMP (SEQ ID NO: 5918), SKKT (SEQ ID NO: 5919), SLPY (SEQ ID NO: 5920), VYHQ (SEQ ID NO: 5921), SYTR (SEQ ID NO: 5922), LVYQ (SEQ ID NO: 5923), YRYQ (SEQ ID NO: 5924), SWLK (SEQ ID NO: 5925), CPAQ (SEQ ID NO: 5926), SMCT (SEQ ID NO: 5927), SPPD (SEQ ID NO: 5928), SKRN (SEQ ID NO: 5929), RWTQ (SEQ ID NO: 5930), PRKQ (SEQ ID NO: 5931), SKCS (SEQ ID NO: 5932), PFVQ (SEQ ID NO: 5933), SKLP (SEQ ID NO: 5934), SKSE (SEQ ID NO: 5935), WVAQ (SEQ ID NO: 5936), SLYQ (SEQ ID NO: 5937), SKVR (SEQ ID NO: 5938), CALQ (SEQ ID NO: 5939), SSCT (SEQ ID NO: 5940), SKNS (SEQ ID NO: 5941), SKRK (SEQ ID NO: 5942), LCTQ (SEQ ID NO: 5943), STCL (SEQ ID NO: 5944), SYAR (SEQ ID NO: 5945), SKQR (SEQ ID NO: 5946), SKRV (SEQ ID NO: 5947), KSGQ (SEQ ID NO: 5948), SYYS (SEQ ID NO: 5949), SLTC (SEQ ID NO: 5950), SCQS (SEQ ID NO: 5951), SKAK (SEQ ID NO: 5952), SKPQ (SEQ ID NO: 5953), FPFQ (SEQ ID NO: 5954), SKCT (SEQ ID NO: 5955), SVFE (SEQ ID NO: 5956), GRYQ (SEQ ID NO: 5957), KAQA (SEQ ID NO: 5958), KAQN (SEQ ID NO: 5959), MYMN (SEQ ID NO: 5960), KAFY (SEQ ID NO: 5961), KLKR (SEQ ID NO: 5962), KRHR (SEQ ID NO: 5963), KAQK (SEQ ID NO: 5964), KWRL (SEQ ID NO: 5965), RCRN (SEQ ID NO: 5966), FTCN (SEQ ID NO: 5967), KFFI (SEQ ID NO: 5968), KAQY (SEQ ID NO: 5969), VWQN (SEQ ID NO: 5970), KYFM (SEQ ID NO: 5971), KARQ (SEQ ID NO: 5972), CHQN (SEQ ID NO: 5973), PWQN (SEQ ID NO: 5974), KIRR (SEQ ID NO: 5975), YYQN (SEQ ID NO: 5976), LYWN (SEQ ID NO: 5977), KPKR (SEQ ID NO: 5978), KAFS (SEQ ID NO: 5979), RFWN (SEQ ID NO: 5980), KAQC (SEQ ID NO: 5981), RMRN (SEQ ID NO: 5982), VKKN (SEQ ID NO: 5983), WAPN (SEQ ID NO: 5984), LWKN (SEQ ID NO: 5985), KARW (SEQ ID NO: 5986), FRPN (SEQ ID NO: 5987), KKVF (SEQ ID NO: 5988), YAFN (SEQ ID NO: 5989), KACS (SEQ ID NO: 5990), KRLW (SEQ ID NO: 5991), CSRN (SEQ ID NO: 5992), RCPN (SEQ ID NO: 5993), GACN (SEQ ID NO: 5994), KFRQ (SEQ ID NO: 5995), FPFN (SEQ ID NO: 5996), FFGN (SEQ ID NO: 5997), MCQN (SEQ ID NO: 5998), KLFW (SEQ ID NO: 5999), KTRK (SEQ ID NO: 6000), GKRN (SEQ ID NO: 6001), YRQN (SEQ ID NO: 6002), RVQN (SEQ ID NO: 6003), GIQN (SEQ ID NO: 6004), KAQR (SEQ ID NO: 6005), NCQN (SEQ ID NO: 6006), KPFR (SEQ ID NO: 6007), LAWN (SEQ ID NO: 6008), KRSY (SEQ ID NO: 6009), SYQN (SEQ ID NO: 6010), WLQN (SEQ ID NO: 6011), SCQN (SEQ ID NO: 6012), SWLN (SEQ ID NO: 6013), KRRA (SEQ ID NO: 6014), KAQT (SEQ ID NO: 6015), KGCT (SEQ ID NO: 6016), KRYT (SEQ ID NO: 6017), GCQN (SEQ ID NO: 6018), FTPN (SEQ ID NO: 6019), TTCN (SEQ ID NO: 6020), KARM (SEQ ID NO: 6021), KRQN (SEQ ID NO: 6022), KCFL (SEQ ID NO: 6023), VPQN (SEQ ID NO: 6024), FWSN (SEQ ID NO: 6025), KFKN (SEQ ID NO: 6026), IKQN (SEQ ID NO: 6027), KAPR (SEQ ID NO: 6028), FRYN (SEQ ID NO: 6029), KMIC (SEQ ID NO: 6030), RWQN (SEQ ID NO: 6031), PTQN (SEQ ID NO: 6032), KWKS (SEQ ID NO: 6033), YMRN (SEQ ID NO: 6034), KAAR (SEQ ID NO: 6035), LCQN (SEQ ID NO: 6036), CCQN (SEQ ID NO: 6037), CVQN (SEQ ID NO: 6038), KLTR (SEQ ID NO: 6039), KLCT (SEQ ID NO: 6040), KIRG (SEQ ID NO: 6041), YLVN (SEQ ID NO: 6042), AFQN (SEQ ID NO: 6043), KACQ (SEQ ID NO: 6044), KWGL (SEQ ID NO: 6045), KILR (SEQ ID NO: 6046), FQIN (SEQ ID NO: 6047), KACI (SEQ ID NO: 6048), KALR (SEQ ID NO: 6049), KAHA (SEQ ID NO: 6050), LCLN (SEQ ID NO: 6051), KAFV (SEQ ID NO: 6052), PRQN (SEQ ID NO: 6053), CPQN (SEQ ID NO: 6054), KAQF (SEQ ID NO: 6055), VRYN (SEQ ID NO: 6056), VRCN (SEQ ID NO: 6057), KMPC (SEQ ID NO: 6058), KKTS (SEQ ID NO: 6059), LPYN (SEQ ID NO: 6060), YHQN (SEQ ID NO: 6061), KAQS (SEQ ID NO: 6062), YTRN (SEQ ID NO: 6063), VYQN (SEQ ID NO: 6064), RYQN (SEQ ID NO: 6065), WLKN (SEQ ID NO: 6066), KAQM (SEQ ID NO: 6067), PAQN (SEQ ID NO: 6068), MCTN (SEQ ID NO: 6069), PPDN (SEQ ID NO: 6070), KRNY (SEQ ID NO: 6071), WTQN (SEQ ID NO: 6072), KACR (SEQ ID NO: 6073), RKQN (SEQ ID NO: 6074), KCSV (SEQ ID NO: 6075), KARI (SEQ ID NO: 6076), FVQN (SEQ ID NO: 6077), KLPK (SEQ ID NO: 6078), KSEQ (SEQ ID NO: 6079), VAQN (SEQ ID NO: 6080), LYQN (SEQ ID NO: 6081), KVRM (SEQ ID NO: 6082), ALQN (SEQ ID NO: 6083), SCTN (SEQ ID NO: 6084), KNSR (SEQ ID NO: 6085), KRKR (SEQ ID NO: 6086), CTQN (SEQ ID NO: 6087), TCLN (SEQ ID NO: 6088), YARN (SEQ ID NO: 6089), KQRP (SEQ ID NO: 6090), KRVV (SEQ ID NO: 6091), SGQN (SEQ ID NO: 6092), YYSN (SEQ ID NO: 6093), LTCN (SEQ ID NO: 6094), CQSN (SEQ ID NO: 6095), KAKG (SEQ ID NO: 6096), KPQN (SEQ ID NO: 6097), PFQN (SEQ ID NO: 6098), KCTS (SEQ ID NO: 6099), VFEN (SEQ ID NO: 6100), or KAKK (SEQ ID NO: 6101).

304. The AAV capsid variant of any one of embodiments 300-303, wherein [B] is or comprises:

(i)

SKAQA, (SEQ ID NO: 6102)

SKAQN, (SEQ ID NO: 6103)

SMYMN, (SEQ ID NO: 6104)

SKAFY, (SEQ ID NO: 6105)

SKLKR, (SEQ ID NO: 6106)

SKRHR, (SEQ ID NO: 6107)

SKAQK, (SEQ ID NO: 6108)

SKWRL, (SEQ ID NO: 6109)

SRCRN, (SEQ ID NO: 6110)

SFTCN, (SEQ ID NO: 6111)

SKFFI, (SEQ ID NO: 6112)

SKAQY, (SEQ ID NO: 6113)

IVWQN, (SEQ ID NO: 6114)

SKYFM, (SEQ ID NO: 6115)

SKARQ, (SEQ ID NO: 6116)

SCHQN, (SEQ ID NO: 6117)

FPWQN, (SEQ ID NO: 6118)

SKIRR, (SEQ ID NO: 6119)

VYYQN, (SEQ ID NO: 6120)

SLYWN, (SEQ ID NO: 6121)

SKPKR, (SEQ ID NO: 6122)

SKAFS, (SEQ ID NO: 6123)

SRFWN, (SEQ ID NO: 6124)

SKAQC, (SEQ ID NO: 6125)

SRMRN, (SEQ ID NO: 6126)

SVKKN, (SEQ ID NO: 6127)

SWAPN, (SEQ ID NO: 6128)

SLWKN, (SEQ ID NO: 6129)

SKARW, (SEQ ID NO: 6130)

SFRPN, (SEQ ID NO: 6131)

SKKVF, (SEQ ID NO: 6132)

SYAFN, (SEQ ID NO: 6133)

SKACS, (SEQ ID NO: 6134)

SKRLW, (SEQ ID NO: 6135)

SCSRN, (SEQ ID NO: 6136)

SRCPN, (SEQ ID NO: 6137)

SGACN, (SEQ ID NO: 6138)

SKFRQ, (SEQ ID NO: 6139)

SFPFN, (SEQ ID NO: 6140)

SFFGN, (SEQ ID NO: 6141)

SMCQN, (SEQ ID NO: 6142)

SKLFW, (SEQ ID NO: 6143)

SKTRK, (SEQ ID NO: 6144)

SGKRN, (SEQ ID NO: 6145)

FYRQN, (SEQ ID NO: 6146)

CRVQN, (SEQ ID NO: 6147)

YGIQN, (SEQ ID NO: 6148)

SKAQR, (SEQ ID NO: 6149)

-continued

VNCQN, (SEQ ID NO: 6150)

SKPFR, (SEQ ID NO: 6151)

SLAWN, (SEQ ID NO: 6152)

SKRSY, (SEQ ID NO: 6153)

WSYQN, (SEQ ID NO: 6154)

RWLQN, (SEQ ID NO: 6155)

PSCQN, (SEQ ID NO: 6156)

SSWLN, (SEQ ID NO: 6157)

SKRRA, (SEQ ID NO: 6158)

SKAQT, (SEQ ID NO: 6159)

SKGCT, (SEQ ID NO: 6160)

VPWQN, (SEQ ID NO: 6161)

SKRYT, (SEQ ID NO: 6162)

SGCQN, (SEQ ID NO: 6163)

SFTPN, (SEQ ID NO: 6164)

STTCN, (SEQ ID NO: 6165)

SKARM, (SEQ ID NO: 6166)

PKRQN, (SEQ ID NO: 6167)

SKCFL, (SEQ ID NO: 6168)

WVPQN, (SEQ ID NO: 6169)

SFWSN, (SEQ ID NO: 6170)

SKFKN, (SEQ ID NO: 6171)

RIKQN, (SEQ ID NO: 6172)

SKAPR, (SEQ ID NO: 6173)

SFRYN, (SEQ ID NO: 6174)

SKMIC, (SEQ ID NO: 6175)

LRWQN, (SEQ ID NO: 6176)

-continued

LPTQN, (SEQ ID NO: 6177)

SKWKS, (SEQ ID NO: 6178)

SYMRN, (SEQ ID NO: 6179)

SKAAR, (SEQ ID NO: 6180)

LLCQN, (SEQ ID NO: 6181)

RCCQN, (SEQ ID NO: 6182)

LCVQN, (SEQ ID NO: 6183)

SKLTR, (SEQ ID NO: 6184)

SKLCT, (SEQ ID NO: 6185)

SKIRG, (SEQ ID NO: 6186)

SYLVN, (SEQ ID NO: 6187)

QGCQN, (SEQ ID NO: 6188)

MAFQN, (SEQ ID NO: 6189)

SKACQ, (SEQ ID NO: 6190)

SKWGL, (SEQ ID NO: 6191)

SKILR, (SEQ ID NO: 6192)

SFQIN, (SEQ ID NO: 6193)

SKACI, (SEQ ID NO: 6194)

SKALR, (SEQ ID NO: 6195)

SKAHA, (SEQ ID NO: 6196)

SLCLN, (SEQ ID NO: 6197)

SKAFV, (SEQ ID NO: 6198)

RPWQN, (SEQ ID NO: 6199)

RPRQN, (SEQ ID NO: 6200)

SCPQN, (SEQ ID NO: 6201)

SKAQF, (SEQ ID NO: 6202)

SVRYN, (SEQ ID NO: 6203)

-continued

SVRCN, (SEQ ID NO: 6204)

SKMPC, (SEQ ID NO: 6205)

SKKTS, (SEQ ID NO: 6206)

SLPYN, (SEQ ID NO: 6207)

VYHQN, (SEQ ID NO: 6208)

SKAQS, (SEQ ID NO: 6209)

SYTRN, (SEQ ID NO: 6210)

LVYQN, (SEQ ID NO: 6211)

YRYQN, (SEQ ID NO: 6212)

SWLKN, (SEQ ID NO: 6213)

SKAQM, (SEQ ID NO: 6214)

CPAQN, (SEQ ID NO: 6215)

SMCTN, (SEQ ID NO: 6216)

SPPDN, (SEQ ID NO: 6217)

SKRNY, (SEQ ID NO: 6218)

RWTQN, (SEQ ID NO: 6219)

SKACR, (SEQ ID NO: 6220)

PRKQN, (SEQ ID NO: 6221)

SKCSV, (SEQ ID NO: 6222)

SKARI, (SEQ ID NO: 6223)

PFVQN, (SEQ ID NO: 6224)

SKLPK, (SEQ ID NO: 6225)

SKSEQ, (SEQ ID NO: 6226)

WVAQN, (SEQ ID NO: 6227)

SLYQN, (SEQ ID NO: 6228)

SKVRM, (SEQ ID NO: 6229)

CALQN, (SEQ ID NO: 6230)

-continued

SSCTN, (SEQ ID NO: 6231)

SKNSR, (SEQ ID NO: 6232)

SKRKR, (SEQ ID NO: 6233)

LCTQN, (SEQ ID NO: 6234)

STCLN, (SEQ ID NO: 6235)

SYARN, (SEQ ID NO: 6236)

SKQRP, (SEQ ID NO: 6237)

SKRVV, (SEQ ID NO: 6238)

KSGQN, (SEQ ID NO: 6239)

SYYSN, (SEQ ID NO: 6240)

SLTCN, (SEQ ID NO: 6241)

SCQSN, (SEQ ID NO: 6242)

SKAKG, (SEQ ID NO: 6243)

SKPQN, (SEQ ID NO: 6244)

FPFQN, (SEQ ID NO: 6245)

SKCTS, (SEQ ID NO: 6246)

SVFEN, (SEQ ID NO: 6247)

SKAKK, (SEQ ID NO: 6248)
or

GRYQN; (SEQ ID NO: 6249)

(ii) an amino acid sequence comprising any portion of an amino acid sequence in (i), e.g., any 2, 3, or 4 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i).

305. The AAV capsid variant of any one of embodiments 300-304, wherein [A]-[B] is or comprises:

(i)
GSGSPHSKAQA, (SEQ ID NO: 6250)

-continued

GSGSPHSKAQN, (SEQ ID NO: 6251)

GSGSPHSMYMN, (SEQ ID NO: 6252)

GSGSPHSKAFY, (SEQ ID NO: 6253)

GSGSPHSKLKR, (SEQ ID NO: 6254)

GSGSPHSKRHR, (SEQ ID NO: 6255)

GSGSPHSKAQK, (SEQ ID NO: 6256)

GSGSPHSKWRL, (SEQ ID NO: 6257)

GSGSPHSRCRN, (SEQ ID NO: 6258)

GSGSPHSFTCN, (SEQ ID NO: 6259)

GSGSPHSKFFI, (SEQ ID NO: 6260)

GSGSPHSKAQY, (SEQ ID NO: 6261)

GSGSPHIVWQN, (SEQ ID NO: 6262)

GSGSPHSKYFM, (SEQ ID NO: 6263)

GSGSPHSKARQ, (SEQ ID NO: 6264)

GSGSPHSCHQN, (SEQ ID NO: 6265)

GSGSPHFPWQN, (SEQ ID NO: 6266)

GSGSPHSKIRR, (SEQ ID NO: 6267)

GSGSPHVYYQN, (SEQ ID NO: 6268)

GSGSPHSLYWN, (SEQ ID NO: 6269)

GSGSPHSKPKR, (SEQ ID NO: 6270)

GSGSPHSKAFS, (SEQ ID NO: 6271)

GSGSPHSRFWN, (SEQ ID NO: 6272)

GSGSPHSKAQC, (SEQ ID NO: 6273)

GSGSPHSRMRN, (SEQ ID NO: 6274)

GSGSPHSVKKN, (SEQ ID NO: 6275)

GSGSPHSWAPN, (SEQ ID NO: 6276)

GSGSPHSLWKN, (SEQ ID NO: 6277)

GSGSPHSKARW, (SEQ ID NO: 6278)

GSGSPHSFRPN, (SEQ ID NO: 6279)

GSGSPHSKKVF, (SEQ ID NO: 6280)

GSGSPHSYAFN, (SEQ ID NO: 6281)

GSGSPHSKACS, (SEQ ID NO: 6282)

GSGSPHSKRLW, (SEQ ID NO: 6283)

GSGSPHSCSRN, (SEQ ID NO: 6284)

GSGSPHSRCPN, (SEQ ID NO: 6285)

GSGSPHSGACN, (SEQ ID NO: 6286)

GSGSPHSKFRQ, (SEQ ID NO: 6287)

GSGSPHSFPFN, (SEQ ID NO: 6288)

GSGSPHSFFGN, (SEQ ID NO: 6289)

GSGSPHSMCQN, (SEQ ID NO: 6290)

GSGSPHSKLFW, (SEQ ID NO: 6291)

GSGSPHSKTRK, (SEQ ID NO: 6292)

GSGSPHSGKRN, (SEQ ID NO: 6293)

GSGSPHFYRQN, (SEQ ID NO: 6294)

GSGSPHCRVQN, (SEQ ID NO: 6295)

GSGSPHYGIQN, (SEQ ID NO: 6296)

GSGSPHSKAQR, (SEQ ID NO: 6297)

GSGSPHVNCQN, (SEQ ID NO: 6298)

GSGSPHSKPFR, (SEQ ID NO: 6299)

GSGSPHSLAWN, (SEQ ID NO: 6300)

GSGSPHSKRSY, (SEQ ID NO: 6301)

GSGSPHWSYQN, (SEQ ID NO: 6302)

GSGSPHRWLQN, (SEQ ID NO: 6303)

GSGSPHPSCQN , (SEQ ID NO: 6304)

-continued

GSGSPHSSWLN, (SEQ ID NO: 6305)

GSGSPHSKRRA, (SEQ ID NO: 6306)

GSGSPHSKAQT, (SEQ ID NO: 6307)

GSGSPHSKGCT, (SEQ ID NO: 6308)

GSGSPHVPWQN, (SEQ ID NO: 6309)

GSGSPHSKRYT, (SEQ ID NO: 6310)

GSGSPHSGCQN, (SEQ ID NO: 6311)

GSGSPHSFTPN, (SEQ ID NO: 6312)

GSGSPHSTTCN, (SEQ ID NO: 6313)

GSGSPHSKARM, (SEQ ID NO: 6314)

GSGSPHPKRQN, (SEQ ID NO: 6315)

GSGSPHSKCFL, (SEQ ID NO: 6316)

GSGSPHWVPQN, (SEQ ID NO: 6317)

GSGSPHSFWSN, (SEQ ID NO: 6318)

GSGSPHSKFKN, (SEQ ID NO: 6319)

GSGSPHRIKQN, (SEQ ID NO: 6320)

GSGSPHSKAPR, (SEQ ID NO: 6321)

GSGSPHSFRYN, (SEQ ID NO: 6322)

GSGSPHSKMIC, (SEQ ID NO: 6323)

GSGSPHLRWQN, (SEQ ID NO: 6324)

GSGSPHLPTQN, (SEQ ID NO: 6325)

GSGSPHSKWKS, (SEQ ID NO: 6326)

GSGSPHSYMRN, (SEQ ID NO: 6327)

GSGSPHSKAAR, (SEQ ID NO: 6328)

GSGSPHLLCQN, (SEQ ID NO: 6329)

GSGSPHRCCQN, (SEQ ID NO: 6330)

GSGSPHLCVQN, (SEQ ID NO: 6331)

-continued

GSGSPHSKLTR, (SEQ ID NO: 6332)

GSGSPHSKLCT, (SEQ ID NO: 6333)

GSGSPHSKIRG, (SEQ ID NO: 6334)

GSGSPHSYLVN, (SEQ ID NO: 6335)

GSGSPHQGCQN, (SEQ ID NO: 6336)

GSGSPHMAFQN, (SEQ ID NO: 6337)

GSGSPHSKACQ, (SEQ ID NO: 6338)

GSGSPHSKWGL, (SEQ ID NO: 6339)

GSGSPHSKILR, (SEQ ID NO: 6340)

GSGSPHSFQIN, (SEQ ID NO: 6341)

GSGSPHSKACI, (SEQ ID NO: 6342)

GSGSPHSKALR, (SEQ ID NO: 6343)

GSGSPHSKAHA, (SEQ ID NO: 6344)

GSGSPHSLCLN, (SEQ ID NO: 6345)

GSGSPHSKAFV, (SEQ ID NO: 6346)

GSGSPHRPWQN, (SEQ ID NO: 6347)

GSGSPHRPRQN, (SEQ ID NO: 6348)

GSGSPHSCPQN, (SEQ ID NO: 6349)

GSGSPHSKAQF, (SEQ ID NO: 6350)

GSGSPHSVRYN, (SEQ ID NO: 6351)

GSGSPHSVRCN, (SEQ ID NO: 6352)

GSGSPHSKMPC, (SEQ ID NO: 6353)

GSGSPHSKKTS, (SEQ ID NO: 6354)

GSGSPHSLPYN, (SEQ ID NO: 6355)

GSGSPHVYHQN, (SEQ ID NO: 6356)

GSGSPHSKAQS, (SEQ ID NO: 6357)

GSGSPHSYTRN, (SEQ ID NO: 6358)

GSGSPHLVYQN, (SEQ ID NO: 6359)

GSGSPHYRYQN, (SEQ ID NO: 6360)

GSGSPHSWLKN, (SEQ ID NO: 6361)

GSGSPHSKAQM, (SEQ ID NO: 6362)

GSGSPHCPAQN, (SEQ ID NO: 6363)

GSGSPHSMCTN, (SEQ ID NO: 6364)

GSGSPHSPPDN, (SEQ ID NO: 6365)

GSGSPHSKRNY, (SEQ ID NO: 6366)

GSGSPHRWTQN, (SEQ ID NO: 6367)

GSGSPHSKACR, (SEQ ID NO: 6368)

GSGSPHPRKQN, (SEQ ID NO: 6369)

GSGSPHSKCSV, (SEQ ID NO: 6370)

GSGSPHSKARI, (SEQ ID NO: 6371)

GSGSPHPFVQN, (SEQ ID NO: 6372)

GSGSPHSKLPK, (SEQ ID NO: 6373)

GSGSPHSKSEQ, (SEQ ID NO: 6374)

GSGSPHWVAQN, (SEQ ID NO: 6375)

GSGSPHSLYQN, (SEQ ID NO: 6376)

GSGSPHSKVRM, (SEQ ID NO: 6377)

GSGSPHCALQN, (SEQ ID NO: 6378)

GSGSPHSSCTN, (SEQ ID NO: 6379)

GSGSPHSKNSR, (SEQ ID NO: 6380)

GSGSPHSKRKR, (SEQ ID NO: 6381)

GSGSPHLCTQN, (SEQ ID NO: 6382)

GSGSPHSTCLN, (SEQ ID NO: 6383)

GSGSPHSYARN, (SEQ ID NO: 6384)

GSGSPHSKQRP, (SEQ ID NO: 6385)

GSGSPHSKRVV, (SEQ ID NO: 6386)

GSGSPHKSGQN, (SEQ ID NO: 6387)

GSGSPHSYYSN, (SEQ ID NO: 6388)

GSGSPHSLTCN, (SEQ ID NO: 6389)

GSGSPHSCQSN, (SEQ ID NO: 6390)

GSGSPHSKAKG, (SEQ ID NO: 6391)

GSGSPHSKPQN, (SEQ ID NO: 6392)

GSGSPHFPFQN, (SEQ ID NO: 6393)

GSGSPHSKCTS , (SEQ ID NO: 6394)

GSGSPHSVFEN, (SEQ ID NO: 6395)

GSGSPHSKAKK, (SEQ ID NO: 6396)
or

GSGSPHGRYQN; (SEQ ID NO: 6397)

(ii) an amino acid sequence comprising any portion of an amino acid sequence in (i), e.g., any 2, 3, 4, 5, 6, 7, 8, 9, or 10 amino acids, e.g., consecutive amino acids, thereof;

(iii) an amino acid sequence comprising one, two, or three but no more than four modifications, e.g., substitutions (e.g., conservative substitutions), insertions, or deletions, relative to any of the amino acid sequences in (i); or (iv) an amino acid sequence comprising one, two, or three but no more than four different amino acids, relative to any one of the amino acid sequences in (i)

306. The AAV capsid of any one of embodiments 300-305, wherein [A]-[B] does not comprise the amino acid sequence of GSGSPHSKAQN (SEQ ID NO: 6251).

307. The AAV capsid variant of any one of embodiments 300-306, which comprises one, two, or all of an amino acid other than Q at position 458 (e.g., R, C, S, W, L, F, Y, H, I, V, A, or P), an amino acid other than Q at position 459 (e.g., K, I, R, L or S), and/or an amino acid other than T at position 460 (e.g., R), numbered relative to SEQ ID NO: 138.

308. The AAV capsid variant of any one of embodiments 300-307, which comprises:
   (i) the amino acid R at position 458;
   (ii) the amino acid W at position 458;
   (iii) the amino acid Y at position 458;
   (iv) the amino acid F at position 458;
   (v) the amino acid S at position 458;
   (vi) the amino acid C at position 458;
   (vii) the amino acid I at position 458;
   (viii) the amino acid L at position 458;
   (ix) the amino acid P at position 458;

(x) the amino acid I at position 459;
(xi) the amino acid H at position 458; or
(xii) the amino acid V at position 458;
wherein (i)-(xii) are numbered according to SEQ ID NO: 138.

309. The AAV capsid variant of any one of embodiments 300-307, which comprises:
(i) the amino acid R at position 458 and the amino acid K at position 459;
(ii) the amino acid C at position 458 and the amino acid I at position 459;
(iii) the amino acid S at position 458 and the amino acid R at position 459'
(iv) the amino acid L at position 458 and the amino acid K at position 459;
(v) the amino acid F at position 458 and the amino acid K at position 459;
(vi) the amino acid C at position 458 and the amino acid R at position 459;
(vii) the amino acid H at position 458 and the amino acid R at position 459;
(viii) the amino acid I at position 458 and the amino acid L at position 459;
(ix) the amino acid V at position 458 and the amino acid R at position 459;
(x) the amino acid A at position 458 and the amino acid K at position 459;
(xi) the amino acid I at position 458 and the amino acid K at position 459;
(xii) the amino acid C at position 458 and the amino acid S at position 459; or
(xiii) the amino acid C at position 458 and the amino acid L at position 459
wherein (i)-(xiii) are numbered according to SEQ ID NO: 138.

310. The AAV capsid variant of any one of embodiments 300-307, which comprises the amino acid F at position 458, the amino acid K at position 459, and the amino acid R at position 460, numbered relative to SEQ ID NO: 138.

311. The AAV capsid variant of any one of embodiments 300-310, which comprises one, two, or all of an amino acid other than T at position 450 (e.g., Y, P, W, R, K, S, or F), an amino acid other than I at position 451 (e.g., R, S, Y, L, V, H, P, A, or F), and/or an amino acid other than N at position 452 (e.g., V, W, A, T, F, Y, L, R, H, S, or M), numbered relative to SEQ ID NO: 138.

312. The AAV capsid variant of any one of embodiments 300-311, which comprises the amino acid V at position 452, numbered according to SEQ ID NO: 138.

313. The AAV capsid variant of any one of embodiments 300-312, which comprises the amino acid Y at position 450 and the amino acid V at position 452, numbered according to SEQ ID NO: 138.

314. The AAV capsid variant of any one of embodiments 300-312, which comprises the amino acid R at position 450 and the amino acid Y at position 451, numbered according to SEQ ID NO: 138.

315. The AAV capsid variant of any one of embodiments 300-311, which comprises: (i) the amino acid P at position 450, the amino acid R at position 451, and the amino acid W at position 452;
(ii) the amino acid Y at position 450, the amino acid S at position 451, and the amino acid A at position 452;
(iii) the amino acid Y at position 450, the amino acid Y at position 451, and the amino acid T at position 452;
(iv) the amino acid P at position 450, the amino acid R at position 451, and the amino acid F at position 452;
(v) the amino acid W at position 450, the amino acid L at position 451, and the amino acid T at position 452;
(vi) the amino acid R at position 450, the amino acid S at position 451, and the amino acid Y at position 452;
(vii) the amino acid Y at position 450, the amino acid V at position 451, and the amino acid F at position 452;
(viii) the amino acid K at position 450, the amino acid H at position 451, and the amino acid L at position 452;
(ix) the amino acid P at position 450, the amino acid P at position 451, and the amino acid L at position 452;
(x) the amino acid P at position 450, the amino acid A at position 451, and the amino acid R at position 452;
(xi) the amino acid S at position 450, the amino acid R at position 451, and the amino acid R at position 452;
(xii) the amino acid F at position 450, the amino acid F at position 451, and the amino acid H at position 452;
(xiii) the amino acid R at position 450, the amino acid F at position 451, and the amino acid S at position 452;
(xiv) the amino acid Y at position 450, the amino acid S at position 451, and the amino acid M at position 452; or
(xv) the amino acid P at position 450, the amino acid F at position 451, and the amino acid L at position 452;
wherein (i)-(xv) is numbered according to SEQ ID NO: 138.

316. The AAV capsid variant of any one of embodiments 300-315, which comprises:
(i) the amino acid sequence of any one of SEQ ID NOs: 3849-3982, 2984-4010, 4681-4693;
(ii) an amino acid sequence comprising any portion of an amino acid sequence in (i), e.g., any 2, 3, 4, 5, 6, 7, 8, 9, 10, 11, 12, 13, 14, 15, 16, or 17 amino acids, e.g., consecutive amino acids, thereof;
(iii) an amino acid sequence comprising one, two, or three but no more than four modifications, e.g., substitutions (e.g., conservative substitutions), insertions, or deletions, relative to any of the amino acid sequences in (i); or
(iv) an amino acid sequence comprising one, two, or three but no more than four different amino acids, relative to any one of the amino acid sequences in (i).

317. The AAV capsid variant of any one of embodiments 300-316, which does not comprise the amino acid sequence of GSGSPHSKAQNQQ (SEQ ID NO: 1801) or GSGSPHSKAQNQQT (SEQ ID NO: 200).

318. The AAV capsid variant of any one of embodiments 300-317, wherein [A]-[B] is present in loop IV.

319. The AAV capsid variant of any one of embodiments 300-318, wherein [A] is present immediately subsequent to position 452, relative to a reference sequence numbered according to the amino acid sequence of SEQ ID NO: 138 or 981.

320. The AAV capsid variant of any one of embodiments 300-319, wherein [A] replaces positions 453-455 (e.g., G453, S454, G455), relative to a reference sequence numbered according to the amino acid sequence of SEQ ID NO: 138 or 981.

321. The AAV capsid variant of any one of embodiments 300-320, wherein [A] is present immediately subsequent to position 452, and wherein [A] replaces positions 453-455 (e.g., G453, S454, G455), relative to a reference sequence numbered according to the amino acid sequence of SEQ ID NO: 138 or 981.

322. The AAV capsid variant of any one of embodiments 300-321, wherein [B] is present immediately subsequent to [A].

323. The AAV capsid variant of any one of embodiments 300-322, wherein [B] replaces positions 456 and 457 (e.g., Q456, N457), numbered relative to SEQ ID NO: 138.

324. The AAV capsid variant of any one of embodiments 300-323, wherein [A]-[B] replaces positions 453-457 (e.g., G453, S454, G455, Q456, N457), relative to a reference sequence numbered according to the amino acid sequence of SEQ ID NO: 138.

325. The AAV capsid variant of any one of embodiments 300-324, wherein [A]-[B] is present immediately subsequent to position 452, and wherein [A]-[B] replaces positions 453-457 (e.g., G453, S454, G455, Q456, N457), relative to a reference sequence numbered according to the amino acid sequence of SEQ ID NO: 138.

326. The AAV capsid variant of any one of embodiments 300-325, which comprises from N-terminus to C-terminus, [A][B].

327. The AAV capsid variant of any one of the preceding embodiments, which comprises at least one, two, three or four (e.g., from 1-4 to 1-5) charged amino acid residues (e.g., acidic and/or basic amino acid residues) relative to SEQ ID NO: 138, which is present N-terminal to the amino acid sequence of SPH (e.g., within 1, 2, 3, 4, 5, or 6 amino acids from the start of the SPH amino acid sequence (e.g., within positions 450-455 numbered according to SEQ ID NO: 138)), optionally wherein the amino acid sequence of SPH is present at positions 456-458 numbered according to any one of SEQ ID NOs: 36-59, 981, or 982.

328. The AAV capsid variant of embodiment 327, wherein the amino acid sequence of SPH is present at positions 456-458 numbered according to any one of SEQ ID NOs: 36-59, 981, or 982.

329. The AAV capsid variant of embodiment 327 or 328, which comprises less than four, less than three, less than two (e.g., two or one) charged amino acid residues (e.g., acidic and/or basic amino acid residues) relative to SEQ ID NO: 138.

330. The AAV capsid variant of any one of embodiments 327-329, which comprises one charged amino acid residues (e.g., an acidic or basic amino acid residue) relative to SEQ ID NO: 138, optionally at any one of positions 450-455 numbered relative to SEQ ID NO: 138.

331. The AAV capsid variant of any one of embodiments 327-330, wherein the charged amino acid residue is an acidic amino acid (e.g., D or E).

332. The AAV capsid variant of any one of embodiments 327-331, wherein the charged amino acid residue is a negatively charged amino acid (e.g., D or E).

333. The AAV capsid variant of any one of embodiments 327-332, wherein the charged amino acid residue is D.

334. The AAV capsid variant of any one of embodiments 327-333, wherein the charged amino acid residue is E.

335. The AAV capsid variant of any one of embodiments 327-334, wherein the charged amino acid residue is a basic amino acid (e.g., K, R, or H).

336. The AAV capsid variant of any one of embodiments 327-335, wherein the charged amino acid residue is a positively charged amino acid (e.g., K, R, or H).

337. The AAV capsid variant of any one of embodiments 327-336, wherein the charged amino acid residue is H.

338. The AAV capsid variant of any one of embodiments 327-337, wherein the charged amino acid residue is R.

339. The AAV capsid variant of any one of embodiments 327-338, wherein the charged amino acid residue is K.

340. The AAV capsid variant of any one of embodiments 327-339, wherein the AAV capsid variant comprises an acidic amino acid (e.g., E or D) and a basic amino acid (e.g., R, K, or H).

341. The AAV capsid variant of any one of embodiments 327-340, at least one, two, three or four charged amino acid residues is present within 1, 2, 3, 4, 5, or 6 (e.g., 1-6) amino acids from the start of the SPH amino acid sequence.

342. The AAV capsid variant of any one of embodiments 327-341, which comprises two charged amino acid residue immediately preceding the amino acid sequence of SPH (e.g., at positions 454 and 455, numbered according to SEQ ID NO: 138 or SEQ ID NO: 982).

343. The AAV capsid variant of any one of embodiments 327-342, which comprises a charged amino acid residue (e.g., E) within 1, 2, 3, 4, 5 (e.g., 5) amino acids from the start of the SPH amino acid sequence.

344. The AAV capsid variant of any one of embodiments 327-343, which comprises a charged amino acid residue (e.g., E) at position 451, numbered according to any one of SEQ ID NO: 138, 981, or 982.

345. The AAV capsid variant of any one of embodiments 327-344, which comprises E at position 451, numbered according to any one of SEQ ID NOs: 138, 981, or 982.

346. The AAV capsid variant of any one of embodiments 327-345, which comprises a charged amino acid residue (e.g., R or K) at position 452, numbered according to any one of SEQ ID NOs: 138, 981, or 982.

347. The AAV capsid variant of any one of embodiments 327-346, which comprises R at position 452, numbered according to SEQ ID NO: 138 or SEQ ID NO: 982.

348. The AAV capsid variant of any one of embodiments 327-347, which comprises E at position 451 and R at position 452, numbered according to SEQ ID NO: 138 or SEQ ID NO: 982.

349. The AAV capsid variant of any one of embodiments 327-348, which has decreased tropism for a liver cell or tissue, relative to the tropism of a reference sequence comprising the amino acid sequence of SEQ ID NO: 138 or SEQ ID NO: 981.

350. The AAV capsid variant of any one of the preceding embodiments, which comprises at least one, two, three or four (e.g., from 1-4 to 1-5) charged amino acid residues (e.g., basic amino acid residues) relative to SEQ ID NO: 138, which is present C-terminal to the amino acid sequence of SPH (e.g., within 1, 2, 3, 4, 5, 6, or 7 amino acids from the end of the SPH amino acid sequence (e.g., within positions 459-465 numbered according to any one of SEQ ID NOs: 36-59, or 981)), optionally wherein the amino acid sequence of SPH is present at positions 456-458 numbered according to any one of SEQ ID NOs: 36-59, 981, or 982.

351. The AAV capsid variant of embodiment 350, wherein the amino acid sequence of SPH is present at positions 456-458 numbered according to any one of SEQ ID NOs: 36-59, 981, or 982.

352. The AAV capsid variant of embodiment 350 or 351, which comprises less than four, less than three, less than two (e.g., two or one) charged amino acid residues (e.g., basic amino acid residues) relative to SEQ ID NO: 138.

353. The AAV capsid variant of any one of embodiments 350-352, which comprises one charged amino acid residues (e.g., an basic amino acid residue) relative to SEQ ID NO: 138, optionally at any one of positions 456-460 numbered relative to SEQ ID NO: 138 or at positions 462-466 numbered according to any one of SEQ ID NOs: 36-59, 981, or 982.

354. The AAV capsid variant of any one of embodiments 350-353, wherein the charged amino acid residue is a basic amino acid (e.g., R or K).

355. The AAV capsid variant of any one of embodiments 350-354, wherein the charged amino acid residue is a positively charged amino acid (e.g., R or K).

356. The AAV capsid variant of any one of embodiments 350-355, wherein the charged amino acid residue is R.

357. The AAV capsid variant of any one of embodiments 350-355, wherein the charged amino acid residue is K.

358. The AAV capsid variant of any one of embodiments 350-357, at least one, two, three or four charged amino acid residues is present within 1, 2, 3, 4, 5, 6, 7 (e.g., 1-7) amino acids from the end of the SPH amino acid sequence.

359. The AAV capsid variant of any one of embodiments 350-358, which comprises a charged amino acid residue (e.g., K or R) immediately after the SPH sequence (e.g., at position 459 numbered according to SEQ ID NO: 981).

360. The AAV capsid variant of any one of embodiments 350-359, which comprises a charged amino acid residue (e.g., K or R) at position 459, numbered according to SEQ ID NO: 138 or SEQ ID NO: 982.

361. The AAV capsid variant of any one of embodiments 350-360, which comprises K at position 459, numbered according to SEQ ID NO: 981.

362. The AAV capsid variant of any one of embodiments 350-360, which comprises R at position 459, numbered according to SEQ ID NO: 981.

363. The AAV capsid variant of any one of embodiments 350-362, which comprises a charged amino acid residue (e.g., R or K) at one, two three, four, five, or all of positions 460, 461, 462, 463, 464, and/or 465, numbered according to SEQ ID NO: 138 or 981.

364. The AAV capsid variant of any one of embodiments 300-326 or 350-363, which has increased tropism for a liver cell or tissue, relative to the tropism of a reference sequence comprising the amino acid sequence of SEQ ID NO: 138.

365. The AAV capsid variant of any one of embodiments 300-326 or 350-364, which is enriched at least about 10, 15, 20, 25, 30, 35, 40, 45, 50, 55, 60, 65, 70, 75, 80, 85, 90, 95, 100, 105, 110, 115, 120, 125, 130, 135, 140, 150, 160, 170, 180, 190, or 200-fold, in the liver compared to a reference sequence of SEQ ID NO: 138, e.g., when measured by an assay as described in Example 4.

366. The AAV capsid variant of any one of embodiments 300-326, 364, or 365, which has reduced tropism for a CNS cell or tissue, e.g., a brain cell, brain tissue, spinal cord cell, or spinal cord tissue, relative to the tropism of a reference sequence comprising the amino acid sequence of SEQ ID NO: 138.

367. The AAV capsid variant of any one of embodiments 300-326 or 364-366, which shows preferential transduction in a liver region relative to the transduction in the brain and/or dorsal root ganglia (DRG).

368. The AAV capsid variant of any one of embodiments 300-326 or 364-367, which shows preferential transduction in a liver region relative to the transduction in the heart and/or muscle (e.g., quadriceps).

369. An AAV capsid variant comprising:
(a) the amino acid sequence of any of the sequences provided in Tables 1, 2A, 2B, 13-19;
(b) an amino acid sequence comprising at least 3, 4, 5, 6, 7, 8, 9, 10, 11, 12, 13, 14, 15, 16, or 17 consecutive amino acids from any one of the sequences provided in Tables 1, 2A, 2B, 13-19; or
(c) an amino acid sequence comprising at least one, two, or three but no more than four different amino acids, relative to any one of the sequences provided in Tables 1, 2A, 2B, 13-19; or
(d) an amino acid sequence comprising at least one, two, or three but no more than four modifications, e.g., substitutions (e.g., conservative substitutions), relative to the amino acid sequence of any one of the sequences provided in Tables 1, 2A, 2B, 13-19.

370. An AAV capsid variant comprising:
(a) the amino acid sequence of any of SEQ ID NOs: 945-980 or 985-986;
(b) an amino acid sequence comprising at least 3, 4, or 5 consecutive amino acids from any one of SEQ ID NOs: 945-980 or 985-986; or
(c) an amino acid sequence comprising at least one, two, or three but no more than four different amino acids, relative to the amino acid sequence of any one of SEQ ID NOs: 945-980 or 985-986;
(d) an amino sequence comprising at least one, two, or three but no more than four modifications, e.g., substitutions (e.g., conservative substitutions), relative to the amino acid sequence of any one of SEQ ID NOs: 945-980 or 985-986.

371. An AAV capsid variant comprising:
(a) the amino acid sequence of any of SEQ ID NOs: 2, 200, 201, 941, 943, 204, 208, 404, or 903-909;
(b) an amino acid sequence comprising at least 3, 4, 5, 6, 7, 8, 9, 10, 11, 12, or 13 consecutive amino acids from any one of SEQ ID NOs: 2, 200, 201, 941, 943, 204, 208, 404, or 903-909;
(c) an amino acid sequence comprising at least one, two, or three but no more than four different amino acids, relative to the amino acid sequence of any one of SEQ ID NOs: 2, 200, 201, 941, 943, 204, 208, 404, or 903-909; or
(d) an amino acid sequence comprising at least one, two, or three but no more than four modifications, e.g., substitutions (e.g., conservative substitutions), relative to the amino acid sequence of any one of SEQ ID NOs: 2, 200, 201, 941, 943, 204, 208, 404, or 903-909.

372. An AAV capsid variant comprising:
(a) the amino acid sequence of any of SEQ ID NOs: 3849-4051 or 4681-4693;
(b) an amino acid sequence comprising at least 3, 4, 5, 6, 7, 8, 9, 10, 11, 12, 13, 14, 15, 16 or 17 consecutive amino acids from any one of SEQ ID NOs: 3849-4051 or 4681-4693;
(c) an amino acid sequence comprising at least one, two, or three but no more than four different amino acids, relative to the amino acid sequence of any one of SEQ ID NOs: 3849-4051 or 4681-4693; or (d) an amino acid sequence comprising at least one, two, or three but no more than four modifications, e.g., substitutions (e.g., conservative substitutions), relative to the amino acid sequence of any one of SEQ ID NOs: 3849-4051 or 4681-4693.

373. An AAV capsid variant comprising:
(a) the amino acid sequence of any of SEQ ID NOs: 4052-4092;
(b) an amino acid sequence comprising at least 3, 4, 5, 6, 7, 8, 9, 10, 11, 12, 13, 14, 15, 16 or 17 consecutive amino acids from any one of SEQ ID NOs: 4052-4092;
(c) an amino acid sequence comprising at least one, two, or three but no more than four different amino acids, relative to the amino acid sequence of any one of SEQ ID NOs: 4052-4092; or
(d) an amino acid sequence comprising at least one, two, or three but no more than four modifications, e.g., substitutions (e.g., conservative substitutions), relative to the amino acid sequence of any one of SEQ ID NOs: 4052-4092.

374. An AAV capsid variant comprising:
(a) the amino acid sequence of any of SEQ ID NOs: 4056, 4058, 4059, 4062-4064, 4066, 4067, 4080, 4084, 4090, or 4095-4097;
(b) an amino acid sequence comprising at least 3, 4, 5, 6, 7, 8, 9, 10, 11, 12, 13, 14, 15, 16 or 17 consecutive amino acids from any one of SEQ ID NOs: 4056, 4058, 4059, 4062-4064, 4066, 4067, 4080, 4084, 4090, or 4095-4097;
(c) an amino acid sequence comprising at least one, two, or three but no more than four different amino acids, relative to the amino acid sequence of any one of SEQ ID NOs: 4056, 4058, 4059, 4062-4064, 4066, 4067, 4080, 4084, 4090, or 4095-4097; or
(d) an amino acid sequence comprising at least one, two, or three but no more than four modifications, e.g., substitutions (e.g., conservative substitutions), relative to the amino acid sequence of any one of SEQ ID NOs: 4056, 4058, 4059, 4062-4064, 4066, 4067, 4080, 4084, 4090, or 4095-4097.

375. The AAV capsid variant of embodiment 369 or 371, comprising an amino acid sequence comprising at least 4, 5, 6, 7, 8, 9, 10, 11, 12, or 13 consecutive amino acids from any one of SEQ ID NOs: 2, 200, 201, 941, 943, 204, 208, 404, or 903-909.

376. The AAV capsid variant of any one of embodiments 369-375, wherein the 3 consecutive amino acids comprise SPH.

377. The AAV capsid variant of any one of embodiments 369-371 or 376, wherein the 4 consecutive amino acids comprise SPHS (SEQ ID NO: 4700).

378. The AAV capsid variant of any one of embodiments 369-371, 376, or 377, wherein the 5 consecutive amino acids comprise SPHSK (SEQ ID NO: 4701).

379. The AAV capsid variant of any one of embodiments 369-371 or 376-378, wherein the 6 consecutive amino acids comprise SPHSKA (SEQ ID NO: 941).

380. The AAV capsid variant of embodiment 369-371, wherein the 3 consecutive amino acids comprise HDS.

381. The AAV capsid variant of any one of embodiments 369-371 or 380, wherein the 4 consecutive amino acids comprise HDSP (SEQ ID NO: 4702).

382. The AAV capsid variant of any one of embodiments 369-371, 380, or 381, wherein the 5 consecutive amino acids comprise HDSPH (SEQ ID NO: 4703).

383. The AAV capsid variant of any one of embodiments 369-371 or 380-382, wherein the 6 consecutive amino acids comprise HDSPHK (SEQ ID NO: 2).

384. The AAV capsid variant of any one of embodiments 369-371, wherein:
(i) the 3 consecutive amino acids comprise SPH; (ii) the 4 consecutive amino acids comprise SPHK (SEQ ID NO: 6398);
(iii) the 5 consecutive amino acids comprise SPHKY (SEQ ID NO: 4715); and/or
(iv) the 6 consecutive amino acids comprise SPHKYG (SEQ ID NO: 966).

385. The AAV capsid variant of embodiment 369 or 371, which comprises an amino acid sequence comprising at least one, two, or three but no more than four modifications, e.g., substitutions (e.g., conservative substitutions), relative to the amino acid sequence of any one of SEQ ID NOs: 2, 200, 201, 941, 943, 204, 208, 404, or 903-909.

386. The AAV capsid variant of any one of embodiments 369,371, or 385, which comprises an amino acid sequence comprising at least one, two, or three but no more than four modifications, e.g., substitutions (e.g., conservative substitutions), relative to the amino acid sequence of SPHSKA (SEQ ID NO: 941).

387. The AAV capsid variant of any one of embodiments 369, 371, or 385, which comprises an amino acid sequence comprising at least one, two, or three but no more than four modifications, e.g., substitutions (e.g., conservative substitutions), relative to the amino acid sequence of HDSPHK (SEQ ID NO: 2).

388. The AAV capsid variant of any one of embodiments 369-371, 384, or 385, which comprises an amino acid sequence comprising at least one, two, or three but no more than four modifications, e.g., substitutions (e.g., conservative substitutions), relative to the amino acid sequence of SPHKYG (SEQ ID NO: 966).

389. The AAV capsid variant of embodiment 370, which comprises:
(i) an amino acid sequence comprising at least one, two, or three but no more than four modifications, e.g., substitutions (e.g., conservative substitutions), relative to the amino acid sequence of KTERVSGSPHSKAQNQQT (SEQ ID NO: 3589);
(ii) an amino acid sequence comprising at least one, two, or three but no more than four modifications, e.g., substitutions (e.g., conservative substitutions), relative to the amino acid sequence of KAEIGHDSPHKSGQNQQT (SEQ ID NO: 1754)
(iii) an amino acid sequence comprising at least one, two, or three but no more than four modifications, e.g., substitutions (e.g., conservative substitutions), relative to the amino acid sequence of KTEKMSGSPHSKAQNQQT (SEQ ID NO: 3241);
(iv) an amino acid sequence comprising at least one, two, or three but no more than four modifications, e.g., substitutions (e.g., conservative substitutions), relative to the amino acid sequence of KTINGHDSPHSKAQNLQT (SEQ ID NO: 4100); or
(v) an amino acid sequence comprising at least one, two, or three but no more than four modifications, e.g., substitutions (e.g., conservative substitutions), relative to the amino acid sequence of KTVNGHDSPHSKAQNQQT (SEQ ID NO: 4062).

390. The AAV capsid variant of embodiment 369 or 371, which comprises an amino acid sequence comprising at least one, two, or three but no more than four different amino acids relative to the amino acid sequence of any one of SEQ ID NOs: 2, 200, 201, 941, 943, 204, 208, 404, or 903-909.

391. The AAV capsid variant of any one of embodiments 369,371, or 390, which comprises an amino acid sequence comprising at least one, two, or three but no more than four different amino acids relative to the amino acid sequence of SPHSKA (SEQ ID NO: 941).

392. The AAV capsid variant of any one of embodiments 369, 371, or 390, which comprises an amino acid sequence comprising at least one, two, or three but no more than four different amino acids relative to the amino acid sequence of HDSPHK (SEQ ID NO: 2).

393. The AAV capsid variant of any one of embodiments 369, 371, 384, or 390, which comprises an amino acid sequence comprising at least one, two, or three but no more than four different amino acids relative to the amino acid sequence of SPHKYG (SEQ ID NO: 966).

394. The AAV capsid variant of embodiment 369, which comprises:
  (i) an amino acid sequence comprising at least one, two, or three but no more than four different amino acids relative to the amino acid sequence of KTERVSGSPHSKAQNQQT (SEQ ID NO: 3589);
  (ii) an amino acid sequence comprising at least one, two, or three but no more than four different amino acids relative to the amino acid sequence of KAEIGHDSPHKSGQNQQT (SEQ ID NO: 1754);
  (iii) an amino acid sequence comprising at least one, two, or three but no more than four different amino acids relative to the amino acid sequence of KTEKMSGSPHSKAQNQQT (SEQ ID NO: 3241);
  (iv) an amino acid sequence comprising at least one, two, or three but no more than four different amino acids relative to the amino acid sequence of KTINGHDSPHSKAQNLQT (SEQ ID NO: 4100); or
  (v) an amino acid sequence comprising at least one, two, or three but no more than four different amino acids relative to the amino acid sequence of KTVNGHDSPHSKAQNQQT (SEQ ID NO: 4062).

395. The AAV capsid variant of any one of embodiments 1-129, 269, 271, 375-388, or 390-394, which comprises the amino acid sequence of any of SEQ ID NOs: 2, 200, 201, 941, 943, 204, 208, 404, or 903-909.

396. The AAV capsid variant of any one of embodiments 295-297, 301-305, 313, 314, 318, 319, or 323, which comprises the amino acid sequence of ERVSGSPHSKA (SEQ ID NO: 6399), optionally wherein the amino acid sequence is present immediately subsequent to position 450 and replaces positions 451-455 (e.g., 1451, N542, G453, S454, G455), numbered according to SEQ ID NO: 138.

397. The AAV capsid variant of any one of embodiments 369-371, 375-379, 385, 386, 389-391, or 394-396, which comprises the amino acid sequence of KTERVSGSPHSKAQNQQT (SEQ ID NO: 3589), optionally wherein the amino acid sequence is present immediately subsequent to position 448 and replaces positions 449-460 (e.g., K449, T450, 1451, N452, G453, S454, G455, Q456, N457, Q458, Q459, T460), numbered according to SEQ ID NO: 138.

398. The AAV capsid variant of any one of embodiments 269-371, 375, 380-383, 385, 387, 389, 390, 393, or 394, which comprises the amino acid sequence of AEIGHDSPHKSG (SEQ ID NO: 6400), optionally wherein the amino acid sequence is present immediately subsequent to position 449 and replaces positions 450-455 (e.g., T450, 1451, N452, G453, S454, G455), numbered according to SEQ ID NO: 138.

399. The AAV capsid variant of any one of embodiments 369-371, 375, 380-383, 385, 387, 389, 390, 393, 394, or 398, which comprises the amino acid sequence of KAEIGHDSPHKSGQNQQT (SEQ ID NO: 1754), optionally wherein the amino acid sequence is present immediately subsequent to position 448 and replaces positions 449-460 (e.g., K449, T450, 1451, N452, G453, S454, G455, Q456, N457, Q458, Q459, T460), numbered according to SEQ ID NO: 138.

400. The AAV capsid variant of any one of embodiments 369-371, 375-379, 390, 391, or 395, which comprises the amino acid sequence of EKMSGSPHSKA (SEQ ID NO: 6401), optionally wherein the amino acid sequence is present immediately subsequent to position 450 and replaces positions 451-455 (e.g., 1451, N452, G453, S454, G455), numbered according to SEQ ID NO: 138.

401. The AAV capsid variant of any one of embodiments 369-371, 375-379, 390, 391, or 395, which comprises the amino acid sequence of KTEKMSGSPHSKAQNQQT (SEQ ID NO: 3241), optionally wherein the amino acid sequence is present immediately subsequent to position 448 and replaces positions 449-460 (e.g., K449, T450, 1451, N452, G453, S454, G455, Q456, N457, Q458, Q459, T460), numbered according to SEQ ID NO: 138.

402. The AAV capsid variant of any one of embodiments 369-371, 375-379, 390, 391, or 395, which comprises the amino acid sequence of HDSPHSKAQNL (SEQ ID NO: 6402), optionally wherein the amino acid sequence is present immediately subsequent to position 453 and replaces positions 456-458 (e.g., Q456, N457, Q458), numbered according to SEQ ID NO: 138.

403. The AAV capsid variant of any one of embodiments 369-371, 375-379, 390, 391, or 395, which comprises the amino acid sequence of KTINGHDSPHSKAQNLQT (SEQ ID NO: 4100), optionally wherein the amino acid sequence is present immediately subsequent to position 448 and replaces positions 449-460 (e.g., K449, T450, 1451, N452, G453, S454, G455, Q456, N457, Q458, Q459, T460), numbered according to SEQ ID NO: 138.

404. The AAV capsid variant of any one of embodiments 369-371, 375-379, 390, 391, or 395, which comprises the amino acid sequence of VNGHDSPHSKA (SEQ ID NO: 6403), optionally wherein the amino acid sequence is present immediately subsequent to position 450 and replaces positions 451-455 (e.g., 1451, N452, G453, S454, G455), numbered according to SEQ ID NO: 138.

405. The AAV capsid variant of any one of embodiments 369-371, 375-379, 390, 391, or 395, which comprises the amino acid sequence of KTVNGHDSPHSKAQNQQT (SEQ ID NO: 4062), optionally wherein the amino acid sequence is present immediately subsequent to position 448 and replaces positions 449-460 (e.g., K449, T450, 1451, N452, G453, S454, G455, Q456, N457, Q458, Q459, T460), numbered according to SEQ ID NO: 138.

406. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, or 395, comprising an amino acid sequence encoded by: the nucleotide sequence of SEQ ID NO: 942; a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 942; or a nucleotide sequence comprising at least one, two, three, four, five, six, or seven, but no more than ten different nucleotides relative to the nucleotide sequence of SEQ ID NO: 942.

407. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, or 395, comprising an amino acid sequence encoded by: the nucleotide sequence of SEQ ID NO: 3; a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 3; or a nucleotide sequence comprising at least one, two, three, four, five, six, or seven, but no more than ten different nucleotides relative to the nucleotide sequence of SEQ ID NO: 3.

408. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, or 406, wherein the nucleotide sequence encoding the capsid variant comprises the nucleotide sequence of SEQ ID NO: 942; a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 942; or a nucleotide sequence comprising at least one, two, three, four, five, six, or seven, but no more than ten different nucleotides relative to the nucleotide sequence of SEQ ID NO: 942.

409. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, or 407, wherein the nucleotide sequence encoding the capsid variant comprises the nucleotide sequence of SEQ ID NO: 3; a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 3; or a nucleotide sequence comprising at least one, two, three, four, five, six, or seven, but no more than ten different nucleotides relative to the nucleotide sequence of SEQ ID NO: 3.

410. The AAV capsid variant of any one of embodiments 369-409, wherein the amino acid sequence is present in loop IV.

411. The AAV capsid variant of any one of embodiments 369-410, wherein the amino acid sequence is present immediately subsequent to position 448, 449, 450, 451, 452, 453, 454, or 455, relative to a reference sequence numbered according to the amino acid sequence of SEQ ID NO: 138.

412. The AAV capsid variant of any one of embodiments 369-411, wherein the amino acid sequence replaces amino acids 449, 450, 451, 452, 453, 454, 455, 456, 457, 458, 459, and/or 460 (e.g., K449, T450, I451, N452, G453, S454, G455, Q456, N457, Q458, Q459, and/or T460), numbered according to the amino acid sequence of SEQ ID NO: 138.

413. The AAV capsid variant of any one of embodiments 369-412, wherein the amino acid sequence is present immediately subsequent to position 455, relative to a reference sequence numbered according to the amino acid sequence of SEQ ID NO: 138.

414. The AAV capsid variant of any one of embodiments 369-413, wherein the amino acid sequence is present immediately subsequent to position 453, relative to a reference sequence numbered according to the amino acid sequence of SEQ ID NO: 138.

415. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, or 410-413, comprising the amino acid sequence of SPHSKA (SEQ ID NO: 941), wherein the amino acid sequence is present immediately subsequent to position 455, relative to a reference sequence numbered according to the amino acid sequence of SEQ ID NO: 138.

416. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, 410-413, or 415, comprising the amino acid sequence of SPHSKA (SEQ ID NO: 941), wherein the amino acid sequence is present immediately subsequent to position 455, relative to a reference sequence numbered according to the amino acid sequence of SEQ ID NO: 981.

417. The AAV capsid variant of embodiment 415 or 416, which further comprises an amino acid other than I at position 451, an amino acid other than N at position 452, and an amino acid other than G at position 453, numbered according to any one of SEQ ID NOs: 36, 138, or 981.

418. The AAV capsid variant of any one of embodiments 415-417, which further comprises E at position 451, R at position 452, and V at position 453, numbered according to any one of SEQ ID NOs: 36, 138, or 981.

419. The AAV capsid variant of any one of embodiments 415-418, which further comprises the substitutions I451E, N452R, and G453V, numbered according to any one of SEQ ID NOs: 36, 138, or 981.

420. The AAV capsid variant of any one of embodiments 415-419, which comprises:
(i) E at position 451, R at position 452, and V at position 453, numbered according to any one of SEQ ID NOs: 36, 138, or 981; and
(ii) the amino acid sequence of SPHSKA (SEQ ID NO: 941), wherein the amino acid sequence is present immediately subsequent to position 455, numbered according to any one of SEQ ID NOs: 36, 138, or 981.

421. The AAV capsid variant of embodiment 415 or 416, which further comprises an amino acid other than I at position 451, an amino acid other than N at position 452, and/or G at position 453, numbered according to SEQ ID NO: 39 or 138.

422. The AAV capsid variant of any one of embodiments 415, 416, or 421, which further comprises E at position 451, K at position 452, and/or M at position 453, numbered according to SEQ ID NO: 138 or 39.

423. The AAV capsid variant of any one of embodiments 415, 416, 421, or 422, which further comprises the substitutions I451E, N452K, and G453M, numbered according to SEQ ID NO: 39 or 138.

424. The AAV capsid variant of any one of embodiments 415, 416, or 421-423, which comprises:
   (i) E at position 451, K at position 452, and M at position 453, numbered according to SEQ ID NO: 39 or 138; and
   (ii) the amino acid sequence of SPHSKA (SEQ ID NO: 941), wherein the amino acid sequence is present immediately subsequent to position 455, numbered according to SEQ ID NO: 39 or 138.

425. The AAV capsid variant of embodiment 415 or 416, which further comprises an amino acid other than S at position 454, an amino acid other than G at position 455, and/or Q at position 458, numbered according to SEQ ID NO: 138.

426. The AAV capsid variant of any one of embodiments 415, 416, or 425, which further comprises H at position 454, D at position 455, and/or L at position 458, numbered according to SEQ ID NO: 138.

427. The AAV capsid variant of any one of embodiments 415, 416, 425, or 426, which further comprises the substitutions S454H, G455D, and Q458L, numbered according to SEQ ID NO: 138.

428. The AAV capsid variant of any one of embodiments 415, 416, or 425-427, which comprises:
   (i) H at position 454, D at position 455, and/or L at position 458, numbered according to SEQ ID NO: 138; and
   (ii) the amino acid sequence of SPHSKA (SEQ ID NO: 941), wherein the amino acid sequence is present immediately subsequent to position 455, numbered according to SEQ ID NO: 138.

429. The AAV capsid variant of embodiment 415 or 416, which further comprises an amino acid other than I at position 451, an amino acid other than S at position 454, and/or an amino acid other than G at position 455, numbered according to SEQ ID NO: 52 or 138.

430. The AAV capsid variant of any one of embodiments 415, 416, or 429, which further comprises V at position 451, H at position 454, and/or D at position 455, numbered according to SEQ ID NO: 52 or 138.

431. The AAV capsid variant of any one of embodiments 415, 416, 429, or 430, which further comprises the substitutions I451V, S454H, and/or G455D, numbered according to SEQ ID NO: 52 or 138.

432. The AAV capsid variant of any one of embodiments 415, 416, or 429-431, which comprises:
   (i) V at position 451, H at position 454, and/or D at position 455, numbered according to SEQ ID NO: 52 or 138; and
   (ii) the amino acid sequence of SPHSKA (SEQ ID NO: 941), wherein the amino acid sequence is present immediately subsequent to position 455, numbered according to SEQ ID NO: 52 or 138.

433. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, or 414, comprising the amino acid sequence of HDSPHK (SEQ ID NO: 2), wherein the amino acid sequence is present immediately subsequent to position 453, numbered according to the amino acid sequence of SEQ ID NO: 138.

434. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, or 433, comprising the amino acid sequence of HDSPHK (SEQ ID NO: 2), wherein the amino acid sequence is present immediately subsequent to position 453, numbered according to the amino acid sequence of SEQ ID NO: 982.

435. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, 433, or 434, comprising the amino acid sequence of SPHKSG (SEQ ID NO: 946), wherein the amino acid sequence is present immediately subsequent to position 455, numbered relative to a reference sequence numbered according to the amino acid sequence of SEQ ID NO: 982.

436. The AAV capsid variant of any one of embodiments 369-435, which comprises:
   (i) the amino acid sequence of HDSPHSKA (SEQ ID NO: 4486), which is present immediately subsequent to position 453; and
   (ii) a deletion of amino acids SG at position 454 and 455;
   wherein (i) and (ii) are numbered according to SEQ ID NO: 138.

437. The AAV capsid variant of any one of embodiments 369-436, which comprises the amino acids HD at position 454 and 455, and further comprises the amino acid sequence of SPHSKA (SEQ ID NO: 941), which is present immediately subsequent to position 455, numbered relative to SEQ ID NO: 138.

438. The AAV capsid variant of any one of embodiments 433-435, which further comprises an amino acid other than T at position 450, an amino acid other than I at position 451, and an amino acid other than N at position 452, numbered according to SEQ ID NO: 138 or 982.

439. The AAV capsid variant of any one of embodiments 433-435 or 438, which further comprises A at position 450, E at position 451, and I at position 452, numbered according to SEQ ID NO: 138 or 982.

440. The AAV capsid variant of any one of embodiments 433-435, 438, or 439, which further comprises the substitutions T450A, I451E, and N452I, numbered according to SEQ ID NO: 138 or 982.

441. The AAV capsid variant of any one of embodiments 433, 434, or 438-440, which comprises:
   (i) A at position 450, E at position 451, and I at position 452, numbered according to SEQ ID NO: 138 or 982; and (ii) the amino acid sequence of HDSPHK (SEQ ID NO: 2), which is present immediately subsequent to positions 453, numbered according to SEQ ID NO: 138 or 982.

442. The AAV capsid variant of any one of embodiments 1-22, 25-27, 31, 34-42, 45-50, 53-63, 69, 79, 83-86, 91-98, 102, 103, 110, 111, 118-129, 369-371, 384, 385, 390, 393, 395, 410-413, comprising the amino acid sequence of SPHKYG (SEQ ID NO: 966), wherein the amino acid sequence is present immediately subsequent to position 455, relative to a reference sequence numbered according to the amino acid sequence of SEQ ID NO: 138.

443. An AAV capsid variant comprising the amino acid sequence of HDSPHK (SEQ ID NO: 2), wherein the amino acid sequence is present immediately subsequent to position 453, numbered according to the amino acid sequence of SEQ ID NO: 982.

444. An AAV capsid variant comprising the amino acid sequence of SPHSKA (SEQ ID NO: 941), wherein the amino acid sequence is present immediately subsequent to position 455, numbered according to the amino acid sequence of SEQ ID NO: 981.

445. An AAV capsid variant comprising the amino acid sequence of HDSPHK (SEQ ID NO: 2), wherein the amino acid sequence is present immediately subsequent to position 453, numbered according to the amino acid sequence of SEQ ID NO: 37, and optionally further comprising:
  (i) one, two, or all of an amino acid other than T at position 450, an amino acid other than I at position 541, and/or an amino acid other than N at position 452, numbered according to SEQ ID NO: 138 or 37;
  (ii) one, two, or all of A at position 450, E at position 451, and/or I at position 452, numbered according to SEQ ID NO: 138 or 37.

446. An AAV capsid variant comprising the amino acid sequence of SPHSKA (SEQ ID NO: 941), wherein the amino acid sequence is present immediately subsequent to position 455, numbered according to the amino acid sequence of any one of SEQ ID NO: 36, 38-55, 57, or 59.

447. The AAV capsid variant of any one of the preceding embodiments, which further comprises:
  (i) a modification, e.g., an insertion, substitution (e.g., conservative substitution), and/or deletion, in loop I, II, VI and/or VIII; and/or
  (ii) a substitution at position K449, e.g., a K449R substitution, numbered according to SEQ ID NO: 138.

448. The AAV capsid variant of any one of the preceding embodiments, which comprises an amino acid sequence comprising at least one, two or three modifications, e.g., substitutions (e.g., conservative substitutions), but not more than 30, 20 or 10 modifications, e.g., substitutions (e.g., conservative substitutions), relative to the amino acid sequence of SEQ ID NO: 138.

449. The AAV capsid variant of any one of the preceding embodiments, which comprises an amino acid sequence comprising at least one, two or three, but no more than 30, 20 or 10 different amino acids relative to the amino acid sequence of SEQ ID NO: 138.

450. The AAV capsid variant of any one of the preceding embodiments, which comprises the amino acid sequence of SEQ ID NO: 138, or an amino acid sequence with at least 80% (e.g., at least about 85, 90, 95, 96, 97, 98, or 99%) sequence identity thereto.

451. The AAV capsid variant of any one of the preceding embodiments, which comprises the amino acid sequence of SEQ ID NO: 138.

452. The AAV capsid variant of any one of the preceding embodiments, which comprises an amino acid sequence encoded by the nucleotide sequence of SEQ ID NO: 137, or a sequence with at least 80% (e.g., at least about 85, 90, 95, 96, 97, 98, or 99%) sequence identity thereto.

453. The AAV capsid variant of any one of the preceding embodiments, wherein the nucleotide sequence encoding the capsid variant comprises the nucleotide sequence of SEQ ID NO: 137, or a sequence with at least 80% (e.g., at least about 85, 90, 95, 96, 97, 98, or 99%) sequence identity thereto.

454. The AAV capsid variant of any one of the preceding embodiments, which comprises a VP1 protein, a VP2 protein, a VP3 protein, or a combination thereof.

455. The AAV capsid variant of any one of embodiments 1-454, which comprises the amino acid sequence corresponding to positions 138-742, e.g., a VP2, of SEQ ID NO: 981 or 982, or a sequence with at least 80% (e.g., at least about 85, 90, 95, 96, 97, 98, or 99%) sequence identity thereto.

456. The AAV capsid variant of any one of embodiments 1-455, which comprises the amino acid sequence corresponding to positions 203-742, e.g., a VP3, of SEQ ID NO: 981 or 982, or a sequence with at least 80% (e.g., at least about 85, 90, 95, 96, 97, 98, or 99%) sequence identity thereto.

457. The AAV capsid variant of any one of embodiments 1-456, which comprises the amino acid sequence corresponding to positions 138-736, e.g., a VP2, of SEQ ID NO: 138, or a sequence with at least 80% (e.g., at least about 85, 90, 95, 96, 97, 98, or 99%) sequence identity thereto.

458. The AAV capsid variant of any one of embodiments 1-457, which comprises the amino acid sequence corresponding to positions 203-736, e.g., a VP3, of SEQ ID NO: 138, or a sequence with at least 80% (e.g., at least about 85, 90, 95, 96, 97, 98, or 99%) sequence identity thereto.

459. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, 410-413, 415-432, 444, or 446-458, comprising an amino acid sequence comprising at least 3, 4, 5, or 6 consecutive amino acids from the amino acid sequence of SPHSKA (SEQ ID NO: 941), wherein:
  (i) the 3 consecutive amino acids comprise SPH;
  (ii) the 4 consecutive amino acids comprise SPHS (SEQ ID NO: 4700);
  (iii) the 5 consecutive amino acids comprise SPHSK (SEQ ID NO: 4701); or
  (iv) the 6 consecutive amino acids comprise SPHSKA (SEQ ID NO: 941);
  wherein the AAV capsid variant comprises: (a) a VP1 protein comprising the amino acid sequence of SEQ ID NO: 138 or SEQ ID NO: 981; (b) a VP2 protein comprising the amino acid sequence of positions 138-736 of SEQ ID NO: 138 or positions 138-742 of SEQ ID NO: 981; (c) a VP3 protein comprising the amino acid sequence of positions 203-736 of SEQ ID

119

NO: 138 or positions 203-742 of SEQ ID NO: 981; or (d) an amino acid sequence with at least 90% (e.g., at least about 95, 96, 97, 98, or 99%) sequence identity to any of the amino acid sequences in (a)-(c).

460. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, 410-413, 415-432, 444, or 446-459, comprising an amino acid sequence comprising at least 3, 4, 5, or 6 consecutive amino acids from the amino acid sequence of SPHSKA (SEQ ID NO: 941), wherein:
   (i) the 3 consecutive amino acids comprise SPH;
   (ii) the 4 consecutive amino acids comprise SPHS (SEQ ID NO: 4700);
   (iii) the 5 consecutive amino acids comprise SPHSK (SEQ ID NO: 4701); or
   (iv) the 6 consecutive amino acids comprise SPHSKA (SEQ ID NO: 941);
   wherein the AAV capsid variant comprises an amino acid sequence at least 90% (e.g., at least about 95, 96, 97, 98, or 99%) identical to the amino acid sequence of SEQ ID NO: 981.

461. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, 410-413, 415-432, 444, or 446-460, comprising one or two, but no more than three substitutions relative to the amino acid sequence of SPHSKA (SEQ ID NO: 941), wherein the AAV capsid variant comprises:
   (a) a VP1 protein comprising the amino acid sequence of SEQ ID NO: 138 or SEQ ID NO: 981;
   (b) a VP2 protein comprising the amino acid sequence of positions 138-736 of SEQ ID NO: 138 or positions 138-742 of SEQ ID NO: 981;
   (c) a VP3 protein comprising the amino acid sequence of positions 203-736 of SEQ ID NO: 138 or positions 203-742 of SEQ ID NO: 981; or
   (d) an amino acid sequence with at least 90% (e.g., at least about 95, 96, 97, 98, or 99%) sequence identity to any of the amino acid sequences in (a)-(c).

462. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, 410-413, 415-432, 444, or 446-461, comprising one or two, but no more than three substitutions relative to the amino acid sequence of SPHSKA (SEQ ID NO: 941), wherein the AAV capsid variant comprises an amino acid sequence at least 90% (e.g., at least about 95, 96, 97, 98, or 99%) identical to the amino acid sequence of SEQ ID NO: 138 or SEQ ID NO: 981.

463. The AAV capsid variant of any one of embodiments 459-462, wherein the amino acid sequence is present immediately subsequent to position 455, numbered according to SEQ ID NO: 138 or 981.

464. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, 433-435, 438-441, 443, 445, or 447-458, comprising an amino acid sequence comprising at least 3, 4, 5, or 6 consecutive amino acids from the amino acid sequence of HDSPHK (SEQ ID NO: 2), wherein:
   (i) the 3 consecutive amino acids comprise HDS;
   (ii) the 4 consecutive amino acids comprise HDSP (SEQ ID NO: 4702);
   (iii) the 5 consecutive amino acids comprise HDSPH (SEQ ID NO: 4703); or
   (iv) the 6 consecutive amino acids comprise HDSPHK (SEQ ID NO: 2);
   wherein the AAV capsid variant comprises: (a) a VP1 protein comprising the amino acid sequence of SEQ ID NO: 138 or SEQ ID NO: 982; (b) a VP2 protein comprising the amino acid sequence of positions 138-736 of SEQ ID NO: 138 or positions 138-742 of SEQ ID NO: 982; (c) a VP3 protein comprising the amino acid sequence of positions 203-736 of SEQ ID NO: 138 or positions 203-742 of SEQ ID NO: 982; or (d) an amino acid sequence with at least 90% (e.g., at least about 95, 96, 97, 98, or 99%) sequence identity to any of the amino acid sequences in (a)-(c).

465. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, 433-435, 438-441, 443, 445, 447-458, or 464, comprising an amino acid sequence comprising at least 3, 4, 5, or 6 consecutive amino acids from the amino acid sequence of HDSPHK (SEQ ID NO: 2), wherein:
   (i) the 3 consecutive amino acids comprise HDS;
   (ii) the 4 consecutive amino acids comprise HDSP (SEQ ID NO: 4702);
   (iii) the 5 consecutive amino acids comprise HDSPH (SEQ ID NO: 4703); or
   (iv) the 6 consecutive amino acids comprise HDSPHK (SEQ ID NO: 2);
   wherein the AAV capsid variant comprises an amino acid sequence at least 90% (e.g., at least about 95, 96, 97, 98, or 99%) identical to the amino acid sequence of SEQ ID NO: 982.

466. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, 433-435, 438-441, 443, 445, 447-458, 464, or 465, comprising one or two, but no more than three substitutions relative to the amino acid sequence of HDSPHK (SEQ ID NO: 2), wherein the AAV capsid variant comprises:
   (a) a VP1 protein comprising the amino acid sequence of SEQ ID NO: 138 or SEQ ID NO: 982;
   (b) a VP2 protein comprising the amino acid sequence of positions 138-736 of SEQ ID NO: 138 or positions 138-742 of SEQ ID NO: 982;
   (c) a VP3 protein comprising the amino acid sequence of positions 203-736 of SEQ ID NO: 138 or positions 203-742 of SEQ ID NO: 982; or
   (d) an amino acid sequence with at least 90% (e.g., at least about 95, 96, 97, 98, or 99%) sequence identity to any of the amino acid sequences in (a)-(c).

467. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, 433-435, 438-441, 443, 445, 447-458, or 464-466, comprising one or two, but no more than three substitutions relative to the amino acid sequence of HDSPHK (SEQ ID NO: 2), wherein the AAV capsid variant comprises an amino acid sequence at least 90% (e.g., at least about 95, 96, 97, 98, or 99%) identical to the amino acid sequence of SEQ ID NO: 982.

468. The AAV capsid variant of any one of embodiments 464-468, wherein the amino acid sequence is present immediately subsequent to position 453, numbered according to SEQ ID NO: 138 or 982.

469. The AAV capsid variant of any one of embodiments 1-468, which comprises the amino acid sequence of any one of SEQ ID NO: 981 or 982, or an amino acid sequence with at least 80% (e.g., at least about 85, 90, 95, 96, 97, 98, or 99%) sequence identity thereto.

470. The AAV capsid variant of any one of embodiments 1-469, which comprises an amino acid sequence comprising at least one, two or three modifications, e.g., substitutions (e.g., conservative substitutions), but not more than 30, 20 or 10 modifications, e.g., substitutions (e.g., conservative substitutions), relative to the amino acid sequence of SEQ ID NO: 981 or 982.

471. The AAV capsid variant of any one of embodiments, 1-470, which comprises an amino acid sequence comprising at least one, two or three, but not more than 30, 20 or 10 different amino acids, relative to the amino acid sequence of SEQ ID NO: 981 or 982.

472. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, 410-413, 415-432, 444, 446-463, or 469-471, which comprises the amino acid sequence of SEQ ID NO: 981, or an amino acid sequence with at least 80% (e.g., at least about 85, 90, 95, 96, 97, 98, or 99%) sequence identity thereto.

473. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, 410-413, 415-432, 444, 446-463, or 469-472, which comprises an amino acid sequence comprising at least one, two or three modifications, e.g., substitutions (e.g., conservative substitutions), but not more than 30, 20 or 10 modifications, e.g., substitutions (e.g., conservative substitutions), relative to the amino acid sequence of SEQ ID NO: 981.

474. The AAV capsid variant of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, 410-413, 415-432, 444, 446-463, or 469-473, which comprises an amino acid sequence comprising at least one, two or three, but not more than 30, 20 or 10 different amino acids, relative to the amino acid sequence of SEQ ID NO: 981.

475. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, 433-435, 438-441, 443, 445, 447-458, or 464-471, which comprises the amino acid sequence of SEQ ID NO: 982, or an amino acid sequence with at least 80% (e.g., at least about 85, 90, 95, 96, 97, 98, or 99%) sequence identity thereto.

476. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, 433-435, 438-441, 443, 445, 447-458, 464-471, or 475, which comprises an amino acid sequence comprising at least one, two or three modifications, e.g., substitutions (e.g., conservative substitutions), but not more than 30, 20 or 10 modifications, e.g., substitutions (e.g., conservative substitutions), relative to the amino acid sequence of SEQ ID NO: 982.

477. The AAV capsid variant of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, 433-435, 438-441, 443, 445, 447-458, 464-471, 475, or 476, which comprises an amino acid sequence comprising at least one, two or three, but not more than 30, 20 or 10 different amino acids, relative to the amino acid sequence of SEQ ID NO: 982.

478. The AAV capsid variant of any one of embodiments 1-477, which comprises an amino acid sequence encoded by the nucleotide sequence of SEQ ID NO: 983 or 984, or a nucleotide sequence with at least 80% (e.g., at least about 85, 90, 95, 96, 97, 98, or 99%) sequence identity thereto.

479. The AAV capsid variant of any one of the preceding embodiments 1-478, wherein the nucleotide sequence encoding the capsid variant comprises the nucleotide sequence of SEQ ID NOs: 983 or 984, or a nucleotide sequence with at least 80% (e.g., at least about 85, 90, 95, 96, 97, 98, or 99%) sequence identity thereto.

480. The AAV capsid variant of any one of the preceding embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, 410-413, 415-432, 444, 446-463, 469-474, 478, or 479, wherein the nucleotide sequence encoding the capsid variant comprises the nucleotide sequence of SEQ ID NO: 983, or a nucleotide sequence with at least 80% (e.g., at least about 85, 90, 95, 96, 97, 98, or 99%) sequence identity thereto.

481. The AAV capsid variant of any one of the preceding embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, 433-435, 438-441, 443, 445, 447-458, 464-471, or 475-479, wherein the nucleotide sequence encoding the capsid variant comprises the nucleotide sequence of SEQ ID NO: 984, or a nucleotide sequence with at least 80% (e.g., at least about 85, 90, 95, 96, 97, 98, or 99%) sequence identity thereto.

482. The AAV capsid variant of any one of the preceding embodiments, wherein the nucleotide sequence encoding the capsid variant is codon optimized.

483. An AAV capsid variant, comprising the amino acid sequence of any one of embodiments 1-23, 26-29, 32, 35-43, 46-51, 54-72, 69-89, 91, 94-99, 102-104, 107, 110-112, 115-129, 168-202, 02, 240-247, 249, 250, 253-263, 266, 272-281, 286, 288, 291-299, 327-363, 369-371, 375-379, 385, 386, 390, 391, 395, 406, 408, 410-413, 415-432, 444, 446-463, 469-474, 478-480, or 482, and further comprising an amino acid sequence at least 95% identical to SEQ ID NO: 981.

484. An AAV capsid variant comprising the amino acid sequence of SEQ ID NO: 981.

485. The AAV capsid variant of embodiment 483 or 484, wherein the nucleotide sequence encoding the AAV capsid variant comprises the nucleotide sequence of SEQ ID NO: 983, or a nucleotide sequence at least 90%, 95%, or 99% identical thereto.

486. An AAV capsid variant, comprising the amino acid sequence of any one of embodiments 1-9, 11, 12-22, 24, 26, 28, 30, 33, 35-42, 44, 46-50, 52, 54-77, 83-88, 90-97, 100-103, 105, 110, 111, 113-129, 203-248, 251, 252, 254-257, 260, 261, 264-280, 283-287, 289-299, 327-363, 369, 369, 371, 380-383, 385, 386, 390, 392, 395, 407, 409-412, 414, 433-435, 438-441, 443, 445, 447-458, 464-471, 475-479, 481, or 482, and further comprising an amino acid sequence at least 95% identical to SEQ ID NO: 982.

487. An AAV capsid variant comprising the amino acid sequence of SEQ ID NO: 982.

488. The AAV capsid variant of embodiment 486 or 487, wherein the nucleotide sequence encoding the AAV capsid variant comprises the nucleotide sequence of SEQ ID NO: 984, or a nucleotide sequence at least 90%, 95%, or 99% identical thereto.

489. An AAV capsid variant comprising an amino acid sequence encoded by the nucleotide sequence of SEQ ID NOs: 983 or 984, or a nucleotide sequence at least 95% identical thereto.

490. An AAV capsid variant comprising the amino acid sequence of any one of SEQ ID NOs: 36-59.

491. An AAV capsid variant comprising an amino acid sequence encoded by the nucleotide sequence of any one of SEQ ID NOs: 12-35, or a nucleotide sequence at least 95% identical thereto.

492. The AAV capsid variant of 490 or 491, wherein the nucleotide sequence encoding the AAV capsid variant comprises the nucleotide sequence of any one of SEQ ID NOs: 12-35, or a nucleotide sequence at least 95% identical thereto.

493. The AAV capsid variant of any one of embodiments 1-299, 369-371, or 375-492, which has an increased tropism for a CNS cell or tissue, e.g., a brain cell, brain tissue, spinal cord cell, or spinal cord tissue, relative to the tropism of a reference sequence comprising the amino acid sequence of SEQ ID NO: 138.

494. The AAV capsid variant of any one of embodiments 1-129, 168-299, 369-371, or 375-493, which transduces a brain region, e.g., a midbrain region (e.g., the hippocampus, or thalamus) or the brain stem, optionally wherein the level of transduction is at least 5, 10, 15, 20, 25, 30, 35, 40, 45, 50, 55, 60, or 65-fold greater as compared to a reference sequence of SEQ ID NO: 138, e.g., when measured by an assay, e.g., an immunohistochemistry assay or a qPCR assay, e.g., as described in Example 2.

495. The AAV capsid variant of any one of embodiments 1-129, 168-299, 369-371, or 375-494, which transduces a brain region, e.g., a midbrain region (e.g., the hippocampus, or thalamus) or the brain stem, optionally wherein the level of transduction is at least 30, 35, 40, 45, 50, 55, 60, or 65-fold greater as compared to a reference sequence of SEQ ID NO: 138, e.g., when measured by an assay, e.g., an immunohistochemistry assay or a qPCR assay, e.g., as described in Example 2.

496. The AAV capsid variant of any one of embodiments 1-129, 168-299, 369-371, or 375-495, which is enriched at least about 3, 4, 5, 6, 7, 8, 9, or 10-fold, in the brain compared to a reference sequence of SEQ ID NO: 138, e.g., when measured by an assay as described in Example 1.

497. The AAV capsid variant of any one of embodiments 1-129, 168-299, 369-371, or 375-496, which is enriched at least about 20, 25, 30, 35, 40, 45, 50, 55, 60, 65, 70, 75, 80 or 85-fold, in the brain compared to a reference sequence of SEQ ID NO: 138, e.g., when measured by an assay as described in Example 1.

498. The AAV capsid variant of any one of embodiments 1-129, 168-299, 369-371, or 375-497, which is enriched in the brain of at least two to three species, e.g., a non-human primate and rodent (e.g., mouse), e.g., as compared to a reference sequence of SEQ ID NO: 138.

499. The AAV capsid variant of any one of embodiments 1-129, 168-299, 369-371, or 375-498, which is enriched at least about 10, 15, 20, 25, 30, 35, 40, 45, 50, 55, 60, 65, 70, 75, 80, 85, 90, 95, 100, 105, 115, 120, 125, 130, 135, 140, 145, 150, 155, 160, 165, 170, 175, 180, 190, 200, 205, or 210-fold, in the brain of at least two to three species, e.g., a non-human primate and rodent (e.g., mouse), compared to a reference sequence of SEQ ID NO: 138, e.g., when measured by an assay as described in Example 1 or 5.

500. The AAV capsid variant of embodiment 498 or 499, wherein the at least two to three species are *Macaca fascicularis, Chlorocebus sabaeus, Callithrix jacchus*, and/or mouse (e.g., BALB/c mice, C57B1/6 mice, and/or CD-1 outbred mice).

501. The AAV capsid variant of any one of embodiments 130-146, 369, 410-414, 447-454, 457, 458, 482, or 493, which is enriched at least about 2, 2.5, 3, 3.5, 4, 4.5, 5, 5.5, 6, 6.5, 7, 7.5, or 8-fold, in the brain compared to a reference sequence of SEQ ID NO: 981, e.g., when measured by an assay as described in Example 3.

502. The AAV capsid variant of any one of embodiments 147-167, 369, 410-414, 447-454, 457, 458, 482, or 493, which is enriched at least about 2, 2.5, 3, 3.5, 4, 4.5, 5, or 5.5-fold, in the brain compared to a reference sequence of SEQ ID NO: 982, e.g., when measured by an assay as described in Example 3.

503. The AAV capsid variant of any one of embodiments 1-129, 168-299, 369-371, or 375-500, which delivers an increased level of a payload to a brain region, optionally wherein the level of the payload is increased by at least 10, 12, 15, 20, 25, 30, 35, 40, 45, 50, 55, 60, 65, or 70-fold, as compared to a reference sequence of SEQ ID NO: 138, e.g., when measured by an assay, e.g., a qRT-PCR or a qPCR assay (e.g., as described in Example 2 or 8).

504. The AAV capsid variant of any one of embodiments 1-129, 168-299, 369-371, 375-500, or 503, which delivers an increased level of viral genomes to a brain region, optionally wherein the level of viral genomes is increased by at least 5, 10, 15, 17, 18, 19, 20, 25, 30, 35, 40, 45, or 50-fold, as compared to a reference sequence of SEQ ID NO: 138, e.g., when measured by an assay, e.g., a qRT-PCR or a qPCR assay (e.g., as described in Example 2 or 8).
505. The AAV capsid variant of embodiment 504 or 504, wherein the brain region is a midbrain region (e.g., the hippocampus or thalamus), frontal cortex, temporal cortex, motor cortex, cerebral cortex, caudate, putamen, dentate nucleus, substantia *nigra*, or the brainstem.
506. The AAV capsid variant of any one of embodiments 1-129, 168-299, 369-371, 375-500, or 503-505, which is enriched at least about 4, 5, 10, 15, 20, 25, 30, or 35-fold, in the spinal cord compared to a reference sequence of SEQ ID NO: 138, e.g., when measured by an assay as described in Example 1 or 8, optionally wherein the region of the spinal cord is a thoracic spinal cord region, cervical spinal cord region, C5 ventral horn region, lumbar spinal cord region, or L5 ventral horn region.
507. The AAV capsid variant of any one of embodiments 1-129, 168-299, 369-371, 375-500, or 503-506, which shows preferential transduction in a brain region relative to the transduction in the dorsal root ganglia (DRG).
508. The AAV capsid variant of any one of embodiments 1-129, 168-299, 369-371, 375-500, or 503-507, which shows preferential transduction in a brain region relative to the liver.
509. The AAV capsid variant of any one of embodiments 1-129, 168-299, 369-371, 375-500, or 503-508, which shows preferential transduction in a brain region relative to the transduction in the heart.
510. The AAV capsid variant of any one of embodiments 1-129, 168-299, 369-371, 375-500, or 503-509, which shows preferential transduction in a brain region relative to the transduction in the dorsal root ganglia (DRG) and the heart.
511. The AAV capsid variant of any one of the preceding embodiments, which is capable of transducing non-neuronal cells, e.g., glial cells (e.g., oligodendrocytes or astrocytes).
512. The AAV capsid variant of embodiment 511, wherein the non-neuronal cells comprise glial cells, oligodendrocytes (e.g., Olig2 positive oligodendrocytes), or astrocytes (e.g., Olig2 positive astrocytes).
513. The AAV capsid variant of any one of the preceding embodiments, which is capable of transducing Olig2 positive cells, e.g., Olig2 positive astrocytes or Olig2 positive oligodendrocytes.
514. The AAV capsid variant of any one of embodiments 369, 373, 447-454, 457, 458, or 482, which has increased tropism for a heart cell or tissue, e.g., a heart ventricle or heart atrium, relative to the tropism of a reference sequence of SEQ ID NO: 138.
515. The AAV capsid variant of any one of embodiments 369, 373, 447-454, 457, 458, 482, or 514, which is enriched at least about 4, 5, 8, 10, 11, 12, 13, 14, 18, 19, 20, 21, 22, 24, 25, 27, 31, 33, or 34-fold, in the heart compared to a reference sequence of SEQ ID NO: 138, e.g., when measured by an assay as described in Example 4.
516. The AAV capsid variant of any one of embodiments 369, 374, 447-454, 457, 458, 482, which has an increased tropism for a muscle cell or tissue (e.g., a quadriceps cell or a quadriceps tissue), relative to the tropism of a reference sequence comprising the amino acid sequence of SEQ ID NO: 138.
517. The AAV capsid variant of any one of embodiments 369, 374, 447-454, 457, 458, 482, which is enriched at least about 4, 5, 8, 12, 17, 18, 20, 26, 27, 28, 30, or 36-fold, in the muscle compared to a reference sequence of SEQ ID NO: 138, e.g., when measured by an assay as described in Example 4.
518. The AAV capsid variant of embodiment 516 or 517, wherein the muscle cell or tissue is a heart muscle (e.g., a heart ventricle or a heart atrium, or both), a quadriceps muscle, or both.
519. The AAV capsid variant of any one of the preceding embodiments, which is isolated, e.g., recombinant.
520. A polynucleotide encoding the AAV capsid variant of any one of embodiments 1-519.
521. The polynucleotide of embodiment 520, which comprises:
  (i) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequences of SEQ ID NO: 3 or 942;
  (ii) a nucleotide sequence comprising at least one, two, three, four, five, six, or seven, but no more than ten different nucleotides, relative to the nucleotide sequences of SEQ ID NO: 3 or 942; or
  (iii) the nucleotide sequence of SEQ ID NOs: 3 or 942, or nucleotide sequence substantially identical (e.g., having at least 70%, 75%, 80%, 85%, 90%, 92%, 95%, 97%, 98%, or 99% sequence identity) thereto.
522. The polynucleotide of embodiment 520 or 521, which comprises the nucleotide sequence of SEQ ID NO: 983 or 984, or a nucleotide sequence with at least 80% (e.g., at least about 85, 90, 95, 96, 97, 98, or 99%) sequence identity thereto.
523. The polynucleotide of any one of embodiments 520-522, which comprises a nucleotide sequence that is codon optimized.
524. A peptide comprising an amino acid sequence having the following formula: [N1]-[N2]-[N3] according to any one of embodiments 1-8, 12-35, 39-45, 48-53, 91, or 118-123.
525. A peptide comprising an amino acid sequence having the following formula: [A][B] according to any one of embodiments 130-133, 142, or 146.
526. A peptide comprising an amino acid sequence having the following formula: [A][B] according to any one of embodiments 147-150, 166, or 167.
527. A peptide comprising an amino acid sequence having the following formula: [N1]-[N2]-[N3] according to any one of embodiments 168-176, 179-186, 191-195, 198-202, or 295-299.
528. A peptide comprising an amino acid sequence having the following formula: [N1]-[N2]-[N3] according to any one of embodiments 203-211, 214-223, 228-231, 234-239, or 295-299.
529. A peptide comprising an amino acid sequence having the following formula: [A]-[B], according to any one of embodiments 300-306, 316, 317, 322, or 326.

530. A peptide comprising:
  (a) the amino acid sequence of any of the sequences provided in Tables 1, 2A, 2B, 13-19;
  (b) an amino acid sequence comprising at least 3, 4, 5, 6, 7, 8, 9, 10, 11, 12, 13, 14, 15, 16, or 17 consecutive amino acids from any one of the sequences provided in Tables 1, 2A, 2B, 13-19;
  (c) an amino acid sequence comprising at least one, two, or three but no more than four different amino acids relative to the amino acid sequence of any one of the sequences provided in Tables 1, 2A, 2B, 13-19; or
  (d) an amino acid sequence comprising at least one, two, or three but no more than four modifications, e.g., substitutions (e.g., conservative substitutions), relative to the amino acid sequence of any one of the sequences provided in Tables 1, 2A, 2B, 13-19.

531. A peptide comprising:
  (a) the amino acid sequence of any of SEQ ID NOs: 3849-4051 or 4681-4693;
  (b) an amino acid sequence comprising at least 3, 4, 5, 6, 7, 8, 9, 10, 11, 12, 13, 14, 15, 16, or 17 consecutive amino acids from any one of SEQ ID NOs: 3849-4051 or 4681-4693;
  (c) an amino acid sequence comprising at least one, two, or three but no more than four different amino acids relative to the amino acid sequence of any one of SEQ ID NOs: 3849-4051 or 4681-4693; or
  (d) an amino acid sequence comprising at least one, two, or three but no more than four modifications, e.g., substitutions (e.g., conservative substitutions), relative to the amino acid sequence of any one of SEQ ID NOs: 3849-4051 or 4681-4693.

532. A peptide comprising:
  (a) the amino acid sequence of any of SEQ ID NOs: 4052-4092;
  (b) an amino acid sequence comprising at least 3, 4, 5, 6, 7, 8, 9, 10, 11, 12, 13, 14, 15, 16, or 17 consecutive amino acids from any one of SEQ ID NOs: 4052-4092;
  (c) an amino acid sequence comprising at least one, two, or three but no more than four different amino acids relative to the amino acid sequence of any one of SEQ ID NOs: 4052-4092; or
  (d) an amino acid sequence comprising at least one, two, or three but no more than four modifications, e.g., substitutions (e.g., conservative substitutions), relative to the amino acid sequence of any one of SEQ ID NOs: 4052-4092.

533. A peptide comprising:
  (a) the amino acid sequence of any of SEQ ID NOs: 4056, 4058, 4059, 4062-4064, 4066, 4067, 4080, 4084, 4090, or 4095-4097;
  (b) an amino acid sequence comprising at least 3, 4, 5, 6, 7, 8, 9, 10, 11, 12, 13, 14, 15, 16, or 17 consecutive amino acids from any one of SEQ ID NOs: 4056, 4058, 4059, 4062-4064, 4066, 4067, 4080, 4084, 4090, or 4095-4097;
  (c) an amino acid sequence comprising at least one, two, or three but no more than four different amino acids relative to the amino acid sequence of any one of SEQ ID NOs: 4056, 4058, 4059, 4062-4064, 4066, 4067, 4080, 4084, 4090, or 4095-4097; or
  (d) an amino acid sequence comprising at least one, two, or three but no more than four modifications, e.g., substitutions (e.g., conservative substitutions), relative to the amino acid sequence of any one of SEQ ID NOs: 4056, 4058, 4059, 4062-4064, 4066, 4067, 4080, 4084, 4090, or 4095-4097.

534. A peptide comprising:
  (a) the amino acid sequence of any of SEQ ID NOs: 945-980 or 985-986;
  (b) an amino acid sequence comprising at least 3, 4, or 5 consecutive amino acids from any one of SEQ ID NOs: 945-980 or 985-986;
  (c) an amino acid sequence comprising at least one, two, or three but no more than four different amino acids relative to the amino acid sequence of any one of SEQ ID NOs: 945-980 or 985-986; or
  (d) an amino acid sequence comprising at least one, two, or three but no more than four modifications, e.g., substitutions (e.g., conservative substitutions), relative to the amino acid sequence of any one of SEQ ID NOs: 945-980 or 985-986.

535. A peptide comprising:
  (a) the amino acid sequence of any of SEQ ID NOs: 2, 200, 201, 941, 943, 204, 208, 404, or 903-909;
  (b) an amino acid sequence comprising at least 3, 4, 5, 6, 7, 8, 9, 10, 11, 12, or 13 consecutive amino acids from any one of SEQ ID NOs: 2, 200, 201, 941, 943, 204, 208, 404, or 903-909;
  (c) an amino acid sequence comprising at least one, two, or three but no more than four different amino acids relative to the amino acid sequence of any one of SEQ ID NOs: 2, 200, 201, 941, 943, 204, 208, 404, or 903-909; or
  (d) an amino acid sequence comprising at least one, two, or three but no more than four modifications, e.g., substitutions (e.g., conservative substitutions), relative to the amino acid sequence of any one of SEQ ID NOs: 2, 200, 201, 941, 943, 204, 208, 404, or 903-909.

536. A peptide comprising:
  (i) the amino acid sequence of SPHSKA (SEQ ID NO: 941);
  (ii) an amino acid sequence comprising at least one, two, or three, but no more than four different amino acids relative to the amino acid sequence of SPHSKA (SEQ ID NO: 941);
  (iii) an amino acid sequence comprising at least one, two, or three modifications, e.g., substitutions (e.g., conservative substitutions), but no more than four modifications, e.g., substitutions (e.g., conservative substitutions), relative to the amino acid sequence of SPHSKA (SEQ ID NO: 941); or
  (iv) at least 3, 4, or 5 consecutive amino acids from the amino acid sequence of SPHSKA (SEQ ID NO: 941).

537. A peptide encoded by:
  (i) the nucleotide sequence of SEQ ID NO: 942, or a nucleotide sequence substantially identical (e.g., having at least 70%, 75%, 80%, 85%, 90%, 92%, 95%, 97%, 98%, or 99% sequence identity) thereto;
  (ii) a nucleotide sequence comprising at least one, two, three, four, five, six, or seven, but no more than ten different nucleotides relative to the nucleotide sequence of SEQ ID NO: 942; or
  (iii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 942.

538. A peptide wherein the nucleotide sequence encoding the peptide comprises:
   (i) the nucleotide sequence of SEQ ID NO: 942, or a nucleotide sequence substantially identical (e.g., having at least 70%, 75%, 80%, 85%, 90%, 92%, 95%, 97%, 98%, or 99% sequence identity) thereto;
   (ii) a nucleotide sequence comprising at least one, two, three, four, five, six, or seven, but not more than 10 different nucleotides, relative to the nucleotide sequence of SEQ ID NO: 942; or
   (iii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 942.

539. A peptide comprising:
   (i) the amino acid sequence of HDSPHK (SEQ ID NO: 2);
   (ii) an amino acid sequence comprising at least one, two, or three, but no more than four different amino acids, relative to the amino acid sequence of HDSPHK (SEQ ID NO: 2);
   (iii) an amino acid sequence comprising at least one, two, or three modifications, e.g., substitutions (e.g., conservative substitutions), but no more than four modifications, e.g., substitutions (e.g., conservative substitutions), relative to the amino acid sequence of HDSPHK (SEQ ID NO: 2); or
   (iv) at least 3, 4, or 5 consecutive amino acids from the amino acid sequence of HDSPHK (SEQ ID NO: 2).

540. A peptide encoded by:
   (i) the nucleotide sequence of SEQ ID NO: 3, or a nucleotide sequence substantially identical (e.g., having at least 70%, 75%, 80%, 85%, 90%, 92%, 95%, 97%, 98%, or 99% sequence identity) thereto; or
   (ii) a nucleotide sequence comprising at least one, two, three, four, five, six, or seven, but no more than ten different nucleotides, relative to the nucleotide sequence of SEQ ID NO: 3
   (iii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 3.

541. A peptide wherein the nucleotide sequence encoding the peptide comprises:
   (i) the nucleotide sequence of SEQ ID NO: 3, or a nucleotide sequence substantially identical (e.g., having at least 70%, 75%, 80%, 85%, 90%, 92%, 95%, 97%, 98%, or 99% sequence identity) thereto;
   (ii) a nucleotide sequence comprising at least one, two, three, four, five, six, or seven, but no more than ten different nucleotides relative to the nucleotide sequence of SEQ ID NO: 3; or
   (iii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 3.

542. A peptide comprising:
   (i) the amino acid sequence of KTERVSGSPHSKAQNQQT (SEQ ID NO: 3589);
   (ii) an amino acid sequence comprising at least one, two, or three, but no more than four different amino acids, relative to the amino acid sequence of KTERVSGSPHSKAQNQQT (SEQ ID NO: 3589);
   (iii) an amino acid sequence comprising at least one, two, or three modifications, e.g., substitutions (e.g., conservative substitutions), but no more than four modifications, e.g., substitutions (e.g., conservative substitutions), relative to the amino acid sequence of KTERVSGSPHSKAQNQQT (SEQ ID NO: 3589); or
   (iv) at least 3, 4, 5, 6, 7, 8, 9, 10, 11, 12, 13, 14, 15, 16 or 17 consecutive amino acids from the amino acid sequence of KTERVSGSPHSKAQNQQT (SEQ ID NO: 3589).

543. A peptide comprising:
   (i) the amino acid sequence of KAEIGHDSPHKSGQNQQT (SEQ ID NO: 1754);
   (ii) an amino acid sequence comprising at least one, two, or three, but no more than four different amino acids, relative to the amino acid sequence of KAEIGHDSPHKSGQNQQT (SEQ ID NO: 1754);
   (iii) an amino acid sequence comprising at least one, two, or three modifications, e.g., substitutions (e.g., conservative substitutions), but no more than four modifications, e.g., substitutions (e.g., conservative substitutions), relative to the amino acid sequence of KAEIGHDSPHKSGQNQQT (SEQ ID NO: 1754); or
   (iv) at least 3, 4, 5, 6, 7, 8, 9, 10, 11, 12, 13, 14, 15, 16 or 17 consecutive amino acids from the amino acid sequence of KAEIGHDSPHKSGQNQQT (SEQ ID NO: 1754).

544. The peptide of any one of embodiments 524-543, which is fused or coupled, e.g., conjugated, to an active agent, e.g., a therapeutic agent or a diagnostic agent.

545. The peptide of any one of embodiments 524-544, wherein at least 1-5, e.g., at least 1, 2, 3, 4, or 5, peptides are fused or coupled, e.g., conjugated, to an active agent, e.g., a therapeutic agent or a diagnostic agent.

546. The peptide of embodiment 545, wherein the at least 1-5, e.g., at least 1, 2, 3, 4, or 5, peptides comprise the same amino acid sequence.

547. The peptide of embodiment 454, wherein the at least 1-5, e.g., at least 1, 2, 3, 4, or 5, peptides comprise different amino acid sequences.

548. The peptide of any one of embodiments 545-547, wherein the at least 1-5, e.g., at least 1, 2, 3, 4, or 5, peptides are present in tandem (e.g., connected directly or indirectly via a linker) or in a multimeric configuration.

549. The peptide of any one of embodiments 524-548, wherein the peptide comprises an amino acid sequence of at least 3, 4, 5, 6, 7, 8, 9, 10, 11, 12, 15, 20, 25, 30, or 35 amino acids in length.

550. The peptide of any one of embodiments 544-549, wherein the active agent is or comprises a therapeutic agent chosen from a protein (e.g., an enzyme), an antibody molecule, a nucleic acid molecule (e.g., an RNAi agent), or a small molecule.

551. The peptide of any one of embodiments 544-549, wherein the active agent is or comprises a ribonucleic acid complex (e.g., a Cas9/gRNA complex), a plasmid, a closed-end DNA, a circ-RNA, or an mRNA.

552. The peptide of any one of embodiments 544-549, wherein the active agent is an RNAi agent.

553. The peptide of embodiment 552, wherein the RNAi agent is a dsRNA, a siRNA, a shRNA, a pre-miRNA, a pri-miRNA, a miRNA, a stRNA, a lncRNA, a piRNA, an antisense oligonucleotide agent (ASO), or a snoRNA, optionally wherein the RNAi agent is an siRNA or an ASO, which further optionally comprises at least one modified nucleotide.

554. The peptide of any one of embodiments 544-553, wherein the active agent modulates, e.g., inhibits, decreases or increases, expression of, a CNS related gene, mRNA, and/or protein.

555. The peptide of any one of embodiments 544-449, wherein the active agent is a diagnostic agent is or comprises an imaging agent (e.g., a protein or small molecule compound coupled to a detectable moiety).

556. The peptide of any one of embodiments 544-555, wherein the peptide covalently linked, e.g., directly or indirectly via a linker, to the active agent.

557. The peptide of any one of embodiments 544-556, wherein the peptide is conjugated to the active agent via a linker.

558. The peptide of embodiment 557, wherein the linker is a cleavable linker or a non-cleavable linker.

559. The peptide of embodiment 558, wherein the cleavable linker is a pH sensitive linker or an enzyme sensitive linker.

560. The peptide of embodiment 558 or 559, wherein:
(i) the pH sensitive linker comprises a hydrazine/hydrazone linker or a disulfide linker;
(ii) the enzyme sensitive linker comprises a peptide based linker, e.g., a peptide linker sensitive to a protease (e.g., a lysosomal protease); or a beta-glucuronide linker; or
(iii) the non-cleavable linker is a linker comprising a thioether group or a maleimidocaproyl group.

561. The peptide of any one of embodiments 544-560, wherein:
(i) the peptide and the active agent are fused or coupled post-translationally, e.g., using click chemistry; or
(ii) the peptide and the active agent are fused or couple via chemically induced dimerization.

562. The peptide of any one of embodiments 544-561, wherein the peptide is present N-terminal relative to the active agent.

563. The peptide of any one of embodiments 544-561, wherein the peptide is present C-terminal relative to the active agent.

564. The peptide of any one of embodiment 544-549, 554, or 556-563, wherein the peptide is present or coupled to a carrier, e.g., an exosome, a microvesicle, or a lipid nanoparticle (LNP), optionally, wherein the carrier comprises a therapeutic agent (e.g., an RNAi agent (e.g., an dsRNA, a siRNA, a shRNA, a pre-miRNA, a pri-miRNA, a miRNA, a stRNA, a lncRNA, a piRNA, an antisense oligonucleotide agent (ASO), or a snoRNA), an mRNA, a ribonucleoprotein complex (e.g., a Cas9/gRNA complex), or a circRNA).

565. The peptide of embodiment 564, wherein the peptide is present on the surface of the carrier, optionally wherein at least 10%, 20%, 30%, 40%, 50%, 60%, 70%, or 80% of the surface of the carrier comprises at least 1-5, e.g., at least 1, 2, 3, 4, or 5 peptides according to any one of embodiments 422-436.

566. An AAV capsid variant, comprising the peptide of any one of embodiments 524-543.

567. A polynucleotide encoding an AAV capsid variant comprising:

(a) the amino acid sequence of any of the sequences provided in Tables 1, 2A, 2B, 13-19;
(b) an amino acid sequence comprising at least 3, 4, 5, 6, 7, 8, 9, 10, 11, 12, 13, 14, 15, 16, or 17 consecutive amino acids from any one of the sequences provided in Tables 1, 2A, 2B, 13-19;
(c) an amino a sequence comprising at least one, two, or three but no more than four different amino acids, relative to the amino acid sequence of any one of the sequences provided in Tables 1, 2A, 2B, 13-19; or
(d) an amino acid sequence comprising at least one, two, or three but no more than four modifications, e.g., substitutions (conservative substitutions), relative to the amino acid sequence of any one of the sequences provided in Tables 1, 2A, 2B, 13-19;
optionally wherein the amino acid sequence of (a), (b), (c), and/or (d) is present immediately subsequent to position 448, 449, 450, 451, 452, 453, 454, or 455, relative to a reference sequence numbered according to the amino acid sequence of SEQ ID NO: 138, 981, or 982.

568. A polynucleotide encoding an AAV capsid variant, wherein the AAV capsid variant comprises:
(i) the amino acid sequence of SPHSKA (SEQ ID NO: 941);
(ii) an amino acid sequence comprising at least one, two, or three, but no more than four different amino acids, relative to the amino acid sequence of SPHSKA (SEQ ID NO: 941);
(iii) an amino acid sequence comprising at least one, two, or three modifications, e.g., substitutions (e.g., conservative substitutions), but no more than four modifications, e.g., substitutions (e.g., conservative substitutions), relative to the amino acid sequence of SPHSKA (SEQ ID NO: 941); or
(iv) at least 3, 4, 5, 6, 7, 8, or 9 consecutive amino acids from the amino acid sequence of SPHSKA (SEQ ID NO: 941);
optionally wherein the amino acid sequence of (i), (ii), (iii), and/or (iv) is present immediately subsequent to position 455, relative to a reference sequence numbered according to the amino acid sequence of SEQ ID NO: 138.

569. The polynucleotide of embodiment 567 or 568, which comprises:
(i) the nucleotide sequence of SEQ ID NO: 942, or a nucleotide sequence substantially identical (e.g., having at least 70%, 75%, 80%, 85%, 90%, 92%, 95%, 97%, 98%, or 99% sequence identity) thereto;
(ii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 942;
(iii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 942.

570. A polynucleotide encoding an AAV capsid variant, wherein the AAV capsid variant comprises:
(i) the amino acid sequence of HDSPHK (SEQ ID NO: 2);
(ii) an amino acid sequence comprising at least one, two, or three, but no more than four different amino acids, relative to the amino acid sequence of HDSPHK (SEQ ID NO: 2);
(iii) an amino acid sequence comprising at least one, two, or three modifications, e.g., substitutions (e.g., conservative substitutions), but no more than four modifications, e.g., substitutions (e.g., conservative substitutions), relative to the amino acid sequence of HDSPHK (SEQ ID NO: 2); or
(iv) at least 3, 4, or 5 consecutive amino acids from the amino acid sequence of HDSPHK (SEQ ID NO: 2);
optionally wherein the amino acid sequence of (i), (ii), (iii), and/or (iv) is present immediately subsequent to position 453, relative to a reference sequence numbered according to the amino acid sequence of SEQ ID NO: 138.

571. The polynucleotide of any one of embodiments 567 or 570, which comprises:
(i) the nucleotide sequence of SEQ ID NO: 3, or a nucleotide sequence substantially identical (e.g., having at least 70%, 75%, 80%, 85%, 90%, 92%, 95%, 97%, 98%, or 99% sequence identity) thereto;
(ii) a nucleotide sequence comprising at least one, two, three, four, five, six, or seven, but no more than ten different nucleotides, relative to the nucleotide sequence of SEQ ID NO: 3; or
(iii) a nucleotide sequence comprising at least one, two, three, four, five, six, or seven modifications, e.g., substitutions (e.g., conservative substitutions), but no more than ten modifications, e.g., substitutions (e.g., conservative substitutions), relative to the nucleotide sequence of SEQ ID NO: 3.

572. The polynucleotide of any one of embodiments 567-571, wherein the AAV capsid variant comprises:
(i) the amino acid sequence of SEQ ID NO: 981 or 982, or an amino acid sequence with at least 80% (e.g., at least about 85, 90, 95, 96, 97, 98, or 99%) sequence identity thereto;
(ii) an amino acid sequence having at least one, two or three, but no more than four different amino acids, relative to the amino acid sequence of SEQ ID NO: 981 or 982; or
(iii) an amino acid sequence having at least one, two or three modifications, e.g., substitutions (e.g., conservative substitutions), but not more than 30, 20 or 10 modifications, e.g., substitutions (e.g., conservative substitutions), relative to the amino acid sequence of SEQ ID NO: 981 or 982.

573. The polynucleotide of any one of embodiments 567-572, comprising the nucleotide sequence of SEQ ID NO: 983 or 984, or a nucleotide sequence with at least 80% (e.g., at least about 85, 90, 95, 96, 97, 98, or 99%) sequence identity thereto.

574. The polynucleotide, peptide, or AAV capsid variant, of any one of embodiments 1-573, which is isolated, e.g., recombinant.

575. An AAV particle comprising the AAV capsid variant of any one of embodiments 1-519, 566, or 574.

576. The AAV particle of embodiment 575, which comprises a nucleotide sequence encoding a payload.

577. The AAV particle of embodiment 576, wherein the encoded payload comprises a therapeutic protein or functional variant thereof; an antibody or antibody fragment; an enzyme; a component of a gene editing system; an RNAi agent (e.g., a dsRNA, siRNA, shRNA, pre-miRNA, pri-miRNA, miRNA, stRNA, lncRNA, piRNA, or snoRNA); or a combination thereof.

578. The AAV particle of embodiment 577, wherein the therapeutic protein or functional variant thereof, e.g., a recombinant protein, is associated with (e.g., aberrantly expressed in) a neurological or neurodegenerative disorder, a muscular or neuromuscular disorder, or a neuro-oncological disorder.

579. The AAV particle of embodiment 577 or 578, the therapeutic protein or functional variant thereof is chosen from apolipoprotein E (APOE) (e.g., ApoE2, ApoE3 and/or ApoE4); human survival of motor neuron (SMN) 1 or SMN2; glucocerebrosidase (GBA1); aromatic L-amino acid decarboxylase (AADC); aspartoacylase (ASPA); tripeptidyl peptidase I (CLN2); beta-galactosidase (GLB1); N-sulphoglucosamine sulphohydrolase (SGSH); N-acetyl-alpha-glucosaminidase (NAGLU); iduronate 2-sulfatase (IDS); intracellular cholesterol transporter (NPC1); gigaxonin (GAN); or a combination thereof.

580. The AAV particle of embodiment 577, wherein the antibody or antibody binding fragment binds to:
(i) a CNS related target, e.g., an antigen associated with a neurological or neurodegenerative disorder, e.g., β-amyloid, APOE, tau, SOD1, TDP-43, huntingtin (HTT), and/or synuclein;
(ii) a muscular or neuromuscular related target, e.g., an antigen associated with a muscular or neuromuscular disorder; or
(iii) a neuro-oncology related target, e.g., an antigen associated with a neuro-oncological disorder, e.g., HER2, or EGFR (e.g., EGFRvIII).

581. The AAV particle of embodiment 577, wherein the enzyme comprises a meganuclease, a zinc finger nuclease, a TALEN, a recombinase, integrase, a base editor, a Cas9, or a fragment thereof.

582. The AAV particle of embodiment 577, wherein the component of a gene editing system comprises one or more components of a CRISPR-Cas system.

583. The AAV particle of embodiment 582, wherein the one or more components of the CRISPR-Cas system comprises a Cas9, e.g., a Cas9 ortholog or a Cpf1, and a single guide RNA (sgRNA), optionally wherein:
(i) the sgRNA is located upstream (5') of the cas9 enzyme; or
(ii) the sgRNA is located downstream (3') of the cas9 enzyme.

584. The AAV particle of embodiment 577, wherein the RNAi agent (e.g., a dsRNA, siRNA, shRNA, pre-miRNA, pri-miRNA, miRNA, stRNA, lncRNA, piRNA, or snoRNA), modulates, e.g., inhibits, expression of, a CNS related gene, mRNA, and/or protein.

585. The AAV particle of embodiment 584, wherein the CNS related gene is chosen from SOD1, MAPT, APOE, HTT, C9ORF72, TDP-43, APP, BACE, SNCA, ATXN1, ATXN3, ATXN7, SCN1A-SCN5A, SCN8A-SCN11A, or a combination thereof.

586. The AAV particle of any one of embodiments 575-585, which comprises a viral genome comprising a promoter operably linked to the nucleic acid sequence encoding the payload.

587. The AAV particle of embodiment 586, wherein the promoter is chosen from human elongation factor 1α-subunit (EF1α), cytomegalovirus (CMV) immediate-early enhancer and/or promoter, chicken β-actin (CBA) and its derivative CAG, β glucuronidase (GUSB), or ubiquitin C (UBC), neuron-specific enolase (NSE), platelet-derived growth factor (PDGF), platelet-derived growth factor B-chain (PDGF-β), intercellular adhesion molecule 2 (ICAM-2), synapsin (Syn), methyl-CpG binding protein 2 (MeCP2), Ca2+/calmodulin-dependent protein kinase II (CaMKII), metabotropic glutamate receptor 2 (mGluR2), neurofilament light (NFL) or heavy (NFH), β-globin minigene nβ2, preproenkephalin (PPE), enkephalin (Enk) and excitatory amino acid transporter 2 (EAAT2), glial fibrillary acidic protein (GFAP), myelin basic protein (MBP), a cardiovascular promoter (e.g., αMHC, cTnT, and CMV-MLC2k), a liver promoter (e.g., hAAT, TBG), a skeletal muscle promoter (e.g., desmin, MCK, C512) or a fragment, e.g., a truncation, or a functional variant thereof.

588. The AAV particle of embodiment 586 or 587, wherein the promoter is an EF-1a promoter variant, e.g., a truncated EF-1a promoter.

589. The AAV particle of any one of embodiments 586-588, wherein the promoter comprises the nucleotide sequence of any one of SEQ ID NOs: 987, 988, 990, 991, 995, 996, 998-1007 or any one of the sequences provided in Table 8, a nucleotide sequence comprising at least one, two, or three but no more than four modifications, e.g., substitutions (e.g., conservative substitutions), relative to the nucleotide sequence of SEQ ID NOs: 987, 988, 990, 991, 995, 996, 998-1007 or any one of the sequences provided in Table 8, or a nucleotide sequence with at least 80% (e.g., 85%, 90%, 95%, 96%, 97%, 98%, or 99%) sequence identity to any one of SEQ ID NOs: 987, 988, 990, 991, 995, 996, 998-1007 or any one of the sequences provided in Table 8.

590. The AAV particle of any one of embodiments 586-589 wherein the viral genome further comprises a polyA signal sequence.

591. The AAV particle of any one of embodiments 586-590, wherein the viral genome further comprises an inverted terminal repeat (ITR) sequence.

592. The AAV particle of any one of embodiments 586-591, wherein the viral genome comprises an ITR sequence positioned 5' relative to the encoded payload.

593. The AAV particle of any one of embodiments 586-592, wherein the viral genome comprises an ITR sequence positioned 3' relative to the encoded payload.

594. The AAV particle of any one of embodiments 586-593, wherein the viral genome comprises an ITR sequence positioned 5' relative to the encoded payload and an ITR sequence positioned 3' relative to the encoded payload.

595. The AAV particle of any one of embodiments 586-594, wherein the viral genome further comprises an enhancer, a Kozak sequence, an intron region, and/or an exon region.

596. The AAV particle of any one of embodiments 586-594, wherein the viral genome further comprises a nucleotide sequence encoding a miR binding site, e.g., a miR binding site that modulates, e.g., reduces, expression of the antibody molecule encoded by the viral genome in a cell or tissue where the corresponding miRNA is expressed.

597. The AAV particle of embodiment 596, wherein the encoded miRNA binding site is complementary, e.g., fully complementary or partially complementary, to a miRNA expressed in a cell or tissue of the DRG, liver, heart, hematopoietic, or a combination thereof.

598. The AAV particle of embodiment 596 or 597, wherein the encoded miR binding site modulates, e.g., reduces, expression of the encoded antibody molecule in a cell or tissue of the DRG, liver, heart, hematopoietic lineage, or a combination thereof.

599. The AAV particle of any one of embodiments 586-598, wherein the viral genome comprises at least 1-5 copies of the encoded miR binding site, e.g., at least 1, 2, 3, 4, or 5 copies.

600. The AAV particle of any one of embodiments 586-599, wherein the viral genome comprises at least 3 copies of an encoded miR binding sites, optionally wherein all three copies comprise the same miR binding site, or at least one, two, three, or all of the copies comprise a different miR binding site.

601. The AAV particle of embodiment 600, wherein the 3 copies of the encoded miR binding sites are continuous (e.g., not separated by a spacer), or are separated by a spacer, optionally wherein the spacer comprises the nucleotide sequence of GATAGTTA, or a nucleotide sequence having at least one, two, or three modifications, e.g., substitutions (e.g., conservative substitutions), but no more than four modifications, e.g., substitutions (e.g., conservative substitutions), relative to the nucleotide sequence of GATAGTTA.

602. The AAV particle of any one of embodiments 586-601, wherein the viral genome comprises at least 4 copies of an encoded miR binding site, optionally wherein all four copies comprise the same miR binding site, or at least one, two, three, or all of the copies comprise a different miR binding site.

603. The AAV particle of embodiment 602, wherein the 4 copies of the encoded miR binding sites are continuous (e.g., not separated by a spacer), or are separated by a spacer, optionally wherein the spacer comprises the nucleotide sequence of GATAGTTA, or a nucleotide sequence having at least one, two, or three modifications, e.g., substitutions (e.g., conservative substitutions), but no more than four modifications, e.g., substitutions (e.g., conservative substitutions), relative to the nucleotide sequence of GATAGTTA.

604. The AAV particle of any one of embodiments 596-603, wherein the encoded miR binding site comprises a miR122 binding site, a miR183 binding site, a miR-1 binding site, a miR-142-3p, or a combination thereof, optionally wherein:
  (i) the encoded miR122 binding site comprises the nucleotide sequence of SEQ ID NO: 4673, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4673;
  (ii) the encoded miR183 binding site comprises the nucleotide sequence of SEQ ID NO: 4676, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4676;
  (iii) the encoded miR-1 binding site comprises the nucleotide sequence of SEQ ID NO: 4679, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4679; and/or (iv) the encoded miR-142-3p binding site comprises the nucleotide sequence of SEQ ID NO: 4675, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4675.

605. The AAV particle of any one of embodiments 586-604, wherein the viral genome comprises an encoded miR122 binding site.

606. The AAV particle of any one of embodiments 586-605, wherein the viral genome comprises at least 1-5 copies, e.g., 1, 2, or 3 copies of a miR122 binding site, optionally wherein each copy is continuous (e.g., not separated by a spacer), or each copy is separated by a spacer, optionally wherein the spacer comprises the nucleotide sequence of GATAGTTA, or a nucleotide sequence having at least one, two, or three modifications, e.g., substitutions (e.g., conservative substitutions), but no more than four modifications, e.g., substitutions (e.g., conservative substitutions), relative to the nucleotide sequence of GATAGTTA.

607. The AAV particle of embodiment 605 or 606, wherein the encoded miR122 binding site comprises the nucleotide sequence of SEQ ID NO: 4673, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4673.

608. The AAV particle of any one of embodiments 586-607, wherein the viral genome comprises: (A) (i) a first encoded miR122 binding site comprising the nucleotide sequence of SEQ ID NO: 4673, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4673;

(ii) a first spacer comprising the nucleotide sequence of GATAGTTA, or a nucleotide sequence having at least one, two, or three modifications, e.g., substitutions (e.g., conservative substitutions), but no more than four modifications, e.g., substitutions (e.g., conservative substitutions), relative to the nucleotide sequence of GATAGTTA; and (iii) a second encoded miR122 binding site comprising the nucleotide sequence of SEQ ID NO: 4673, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4673; or (B) (i) a first encoded miR122 binding site comprising the nucleotide sequence of SEQ ID NO: 4673, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4673;

(ii) a first spacer comprising the nucleotide sequence of GATAGTTA, or a nucleotide sequence having at least one, two, or three modifications, e.g., substitutions (e.g., conservative substitutions), but no more than four modifications, e.g., substitutions (e.g., conservative substitutions), relative to the nucleotide sequence of GATAGTTA;

(iii) a second encoded miR122 binding site comprising the nucleotide sequence of SEQ ID NO: 4673, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4673;

(iv) a second spacer comprising the nucleotide sequence of GATAGTTA, or a nucleotide sequence having at least one, two, or three modifications, e.g., substitutions (e.g., conservative substitutions), but no more than four modifications, e.g., substitutions (e.g., conservative substitutions), relative to the nucleotide sequence of GATAGTTA; and (v) a third encoded miR122 binding site comprising the nucleotide sequence of SEQ ID NO: 4673, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4673.

609. The AAV particle of any one of embodiments 586-608, wherein the viral genome comprises an encoded miR183 binding site.

610. The AAV particle of any one of embodiments 586-609, wherein the viral genome comprises at least 1-5 copies, e.g., 1, 2, or 3 copies of a miR183 binding site, optionally wherein each copy is continuous (e.g., not separated by a spacer), or each copy is separated by a spacer, optionally wherein the spacer comprises the nucleotide sequence of GATAGTTA, or a nucleotide sequence having at least one, two, or three modifications, e.g., substitutions (e.g., conservative substitutions), but no more than four modifications, e.g., substitutions (e.g., conservative substitutions), relative to the nucleotide sequence of GATAGTTA.

611. The AAV particle of embodiment 609 or 610, wherein the encoded miR183 binding site comprises the nucleotide sequence of SEQ ID NO: 4673, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4673.

612. The AAV particle of any one of embodiments 586-611, wherein the viral genome comprises:
   (A) (i) a first encoded miR183 binding site comprising the nucleotide sequence of SEQ ID NO: 4676, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4676;
   (ii) a first spacer comprising the nucleotide sequence of GATAGTTA, or a nucleotide sequence having at least one, two, or three modifications, e.g., substitutions (e.g., conservative substitutions), but no more than four modifications, e.g., substitutions (e.g., conservative substitutions), relative to the nucleotide sequence of GATAGTTA; and
   (iii) a second encoded miR183 binding site comprising the nucleotide sequence of SEQ ID NO: 4676, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4676; or
   (B) (i) a first encoded miR183 binding site comprising the nucleotide sequence of SEQ ID NO: 4676, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4676;
   (ii) a first spacer comprising the nucleotide sequence of GATAGTTA, or a nucleotide sequence having at least one, two, or three modifications, e.g., substitutions (e.g., conservative substitutions), but no more than four modifications, e.g., substitutions (e.g., conservative substitutions), relative to GATAGTTA;
   (iii) a second encoded miR183 binding site comprising the nucleotide sequence of SEQ ID NO: 4676, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4676;
   (iv) a second spacer comprising the nucleotide sequence of GATAGTTA, or a nucleotide sequence having at least one, two, or three modifications, e.g., substitutions (e.g., conservative substitutions), but no more than four modifications, e.g., substitutions (e.g., conservative substitutions), relative to the nucleotide sequence of GATAGTTA; and
   (v) a third encoded miR183 binding site comprising the nucleotide sequence of SEQ ID NO: 4676, or a nucleotide sequence substantially identical (e.g., having at least 70%, 75%, 80%, 85%, 90%, 92%, 95%, 97%, 98%, or 99% sequence identity) thereto; or a nucleotide sequence having at least one, two, three, four, five, six, or seven modifications, e.g., substitutions (e.g., conservative substitutions), but no more than ten modifications, e.g., substitutions (e.g., conservative substitutions), relative to SEQ ID NO: 4676.

613. The AAV particle of any one of embodiments 586-612, wherein the viral genome comprises an encoded miR122 binding site and a miR-1 binding site.

614. The AAV particle of any one of embodiments 586-613, wherein the viral genome is single stranded.

615. The AAV particle of any one of embodiments 586-613, wherein the viral genome self-complementary.

616. The AAV particle of any one of embodiments 586-615, wherein the viral genome further comprises a nucleotide sequence encoding a Rep protein, e.g., a non-structural protein, wherein the Rep protein comprises a Rep78 protein, a Rep68, Rep52 protein, and/or a Rep40 protein (e.g., a Rep78 and a Rep52 protein).

617. The AAV particle of any one of embodiments 586-615, wherein the AAV particle further comprises a nucleotide sequence encoding a Rep protein, e.g., a non-structural protein, wherein the Rep protein comprises a Rep78 protein, a Rep68, Rep52 protein, and/or a Rep40 protein (e.g., a Rep78 and a Rep52 protein).

618. The AAV particle of embodiment 616 or 617, wherein the Rep78 protein, the Rep68 protein, the Rep52 protein, and/or the Rep40 protein are encoded by at least one Rep gene.

619. The AAV particle of any one of embodiments 586-618, wherein the viral genome further comprises a nucleic acid sequence encoding the AAV capsid variant of any one of embodiments 1-519, 566, or 574.

620. The AAV particle of any one of embodiments 575-519, which is isolated, e.g., recombinant.

621. A vector comprising a polynucleotide encoding the AAV capsid variant of any one of embodiments 1-519, 566, or 574, the polynucleotide of any one of embodiments 520-523 or 567-574, or a polynucleotide encoding the peptide of any one of embodiments 524-543 or 574.

622. A cell, e.g., a host cell, comprising the AAV capsid variant of any one of embodiments 1-519, 566, or 574, the polynucleotide of any one of embodiments 520-523 or 567-574, the peptide of any one of embodiments 524-565 or 574, the AAV particle of any one of embodiments 575-620, or the vector of embodiment 621.

623. The cell of embodiment 622, wherein the cell is a mammalian cell or an insect cell.
624. The cell of embodiment 622 or 623, wherein the cell is a cell of a brain region or a spinal cord region, optionally a cell of the brain stem, hippocampus, or thalamus.
625. The cell of any one of embodiments 622-624, wherein the cell is a neuron, a sensory neuron, a motor neuron, an astrocyte, a glial cell, oligodendrocyte, or a muscle cell (e.g., a cell of the heart, diaphragm, or quadriceps).
626. The cell of embodiment 622 or 623, wherein the cell is a liver cell.
627. A method of making an AAV particle, comprising
(i) providing a host cell comprising a viral genome; and
(ii) incubating the host cell under conditions suitable to enclose the viral genome in the AAV capsid variant of any one of embodiments 1-519, 566, or 574 or an AAV capsid variant encoded by the polynucleotide of any one of embodiments 520-523 or 567-574;
thereby making the AAV particle.
628. The method of embodiment 627, further comprising, prior to step (i), introducing a first nucleic acid molecule comprising the viral genome into the host cell.
629. The method of embodiment 628, wherein the host cell comprises a second nucleic acid encoding the capsid variant.
630. The method of embodiment 629, wherein the second nucleic acid molecule is introduced into the host cell prior to, concurrently with, or after the first nucleic acid molecule.
631. A pharmaceutical composition comprising the AAV particle of any one of embodiments 575-620, an AAV particle comprising the capsid variant of any one of embodiments 1-519, 566, or 574, an AAV particle comprising the peptide of any one of embodiments 524-543 or 574, and a pharmaceutically acceptable excipient.
632. A method of delivering a payload to a cell or tissue (e.g., a CNS cell, CNS tissue, a liver cell, or a liver tissue), comprising administering an effective amount of the pharmaceutical composition of embodiment 631, the AAV particle of any one of embodiments 575-620, an AAV particle comprising the capsid variant of any one of embodiments 1-519, 566, or 574, or an AAV particle comprising the peptide of any one of embodiments 524-543 or 574.
633. The method of embodiment 632, wherein the cell is a cell of a brain region or a spinal cord region, optionally a cell of the frontal cortex, sensory cortex, motor cortex, caudate, cerebellar cortex, cerebral cortex, brain stem, hippocampus, or thalamus.
634. The method of embodiment 632 or 633, wherein the cell is a neuron, a sensory neuron, a motor neuron, an astrocyte, a glial cell, or an oligodendrocyte.
635. The method of embodiment 632, wherein the cell is a liver cell.
636. The method of any one of embodiments 632-635, wherein the cell or tissue is within a subject.
637. The method of embodiment 636, wherein the subject has, has been diagnosed with having, or is at risk of having a genetic disorder, e.g., a monogenic disorder or a polygenic disorder.
638. The method of embodiment 636 or 637, wherein the subject has, has been diagnosed with having, or is at risk of having a neurological, e.g., a neurodegenerative disorder.
639. The method of embodiment 636 or 637, wherein the subject has, has been diagnosed with having, or is at risk of having a neuro-oncological disorder.
640. The method of embodiment 636 or 637, wherein the subject has, has been diagnosed with having, or is at risk of having a muscular disorder or a neuromuscular disorder.
641. A method of treating a subject having or diagnosed with having a genetic disorder, e.g., a monogenic disorder or a polygenic disorder, comprising administering to the subject an effective amount of the pharmaceutical composition of embodiment 631, the AAV particle of any one of embodiments 575-620, an AAV particle comprising the capsid variant of any one of embodiments 1-519, 566, or 574, or an AAV particle comprising the peptide of any one of embodiments 524-543 or 574.
642. A method of treating a subject having or diagnosed with having a neurological disorder, e.g., a neurodegenerative disorder, comprising administering to the subject an effective amount of the pharmaceutical composition of embodiment 631, the AAV particle of any one of embodiments 575-620, an AAV particle comprising the capsid variant of any one of embodiments 1-519, 566, or 574, or an AAV particle comprising the peptide of any one of embodiments 524-543 or 574.
643. A method of treating a subject having or diagnosed with having a muscular disorder or a neuromuscular disorder, comprising administering to the subject an effective amount of the pharmaceutical composition of embodiment 631, the AAV particle of any one of embodiments 575-620, an AAV particle comprising the capsid variant of any one of embodiments 1-519, 566, or 574, or an AAV particle comprising the peptide of any one of embodiments 524-543 or 574.
644. A method of treating a subject having or diagnosed with having a neuro-oncological disorder, comprising administering to the subject an effective amount of the pharmaceutical composition of embodiment 631, the AAV particle of any one of embodiments 575-620, an AAV particle comprising the capsid variant of any one of embodiments 1-519, 566, or 574, or an AAV particle comprising the peptide of any one of embodiments 524-543 or 574.
645. The method of any one of embodiments 637-645, wherein the genetic disorder, neurological disorder, neurodegenerative disorder, muscular disorder, neuromuscular disorder, or neuro-oncological disorder is Huntington's Disease, Amyotrophic Lateral Sclerosis (ALS), Gaucher Disease, Dementia with Lewy Bodies, Parkinson's disease, Spinal Muscular Atrophy, Alzheimer's Disease, a leukodystrophy (e.g., Alexander disease, autosomal dominant leukodystrophy with autonomic diseases (ADLD), Canavan disease, cerebrotendinous xanthomatosis (CTX), metachromatic leukodystrophy (MLD), Pelizaeus-Merzbacher disease, or Refsum disease), or a cancer (e.g., a HER2/neu positive cancer or a glioblastoma)'.
646. The method of any one of embodiments 641-645, where treating comprises prevention of progression of the disease or disorder in the subject.
647. The method of embodiment 636-646, wherein the subject is a human.
648. The method of any one of embodiments 636-647, wherein the AAV particle is administered to the subject intravenously, via intra-cisterna magna injection (ICM), intracerebrally, intrathecally, intracerebroventricularly, via intraparenchymal administration, intraarterially, or intramuscularly.

649. The method of any one of embodiments 636-648, wherein the AAV particle is administered to the subject via focused ultrasound (FUS), e.g., coupled with the intravenous administration of microbubbles (FUS-MB), or MRI-guided FUS coupled with intravenous administration.

650. The method of any one of embodiments 636-649, wherein the AAV particle is administered to the subject intravenously.

651. The method of any one of embodiments 636-650, wherein the AAV particle is administered to the subject via intra-cisterna magna injection (ICM).

652. The method of any one of embodiments 636-651, wherein the AAV particle is administered to the subject intraarterially.

653. The method of any one of embodiments 648-652, wherein administration of the AAV particle results in a decreased presence, level, and/or activity of a gene, mRNA, protein, or combination thereof.

654. The method of any one of embodiments 648-652, wherein administration of the AAV particle results in an increased presence, level, and/or activity of a gene, mRNA, protein, or a combination thereof.

655. The pharmaceutical composition of embodiment 631, the AAV particle of any one of embodiments 575-620, an AAV particle comprising the capsid variant of any one of embodiments 1-519, 566, or 574, or an AAV particle comprising the peptide of any one of embodiments 524-543 or 574, for use in a method of delivering a payload to a cell or tissue.

656. The pharmaceutical composition of embodiment 631, the AAV particle of any one of embodiments 575-620, an AAV particle comprising the capsid variant of any one of embodiments 1-519, 566, or 574, or an AAV particle comprising the peptide of any one of embodiments 524-543 or 574, for use in a method of treating a genetic disorder, a neurological disorder, a neurodegenerative disorder, a muscular disorder, a neuromuscular disorder, or a neuro-oncological disorder.

657. The pharmaceutical composition of embodiment 631, the AAV particle of any one of embodiments 575-620, an AAV particle comprising the capsid variant of any one of embodiments 1-519, 566, or 574, or an AAV particle comprising the peptide of any one of embodiments 524-543 or 574, for use in the manufacture of a medicament.

658. Use of the pharmaceutical composition of embodiment 631, the AAV particle of any one of embodiments 575-620, an AAV particle comprising the capsid variant of any one of embodiments 1-519, 566, or 574, or an AAV particle comprising the peptide of any one of embodiments 524-543 or 574, in the manufacture of a medicament.

659. Use of the pharmaceutical composition of embodiment 631, the AAV particle of any one of embodiments 575-620, an AAV particle comprising the capsid variant of any one of embodiments 1-519, 566, or 574, or an AAV particle comprising the peptide of any one of embodiments 524-543 or 574, in the manufacture of a medicament for treating a genetic disorder, a neurological disorder, a neurodegenerative disorder, a muscular disorder, a neuromuscular disorder, or a neuro-oncological disorder.

The details of one or more embodiments of the disclosure are set forth in the accompanying description below. Other features, objects and advantages of the disclosure will be apparent from the description. In the description, the singular forms also include the plural unless the context clearly dictates otherwise. Certain terms are defined in the Definition section and throughout.

DETAILED DESCRIPTION OF THE DISCLOSURE

Described herein, inter alia, are compositions comprising an AAV capsid variant, e.g., an AAV capsid variant described herein, and methods of making and using the same. Generally, the AAV capsid variant has enhanced tropism for a cell or tissue, e.g., for the delivery of a payload to said cell or tissue, for example a CNS tissue or a CNS cell or a liver cell or liver tissue.

As demonstrated in the Examples herein below, certain AAV capsid variants described herein show multiple advantages over wild-type AAV9, including (i) increased penetrance through the blood brain barrier following intravenous administration, (ii) wider distribution throughout the multiple brain regions, e.g., frontal cortex, sensory cortex, motor cortex, putamen, thalamus, cerebellar cortex, dentate nucleus, caudate, and/or hippocampus, and/or (iii) elevated payload expression in multiple brain regions. Without wishing to be being bound by theory, it is believed that these advantages may be due, in part, to the dissemination of the AAV capsid variants through the brain vasculature. In some embodiments, the AAV capsids described herein enhance the delivery of a payload to multiple regions of the brain including for example, the frontal cortex, sensory cortex, motor cortex, putamen, thalamus, cerebellar cortex, dentate nucleus, caudate, and/or hippocampus.

Several approaches have been used previously to produce AAV capsids with enhanced tropism for a cell or tissue, e.g., a CNS cell or tissue. One approach used co-infection of cultured cells (Grimm et al. In vitro and in vivo gene therapy vector evolution via multispecies interbreeding and retargeting of adeno-associated viruses. J. Virol. 2008 June 82(12):5887-5911, the contents of which are herein incorporated by reference in its entirety) or in situ animal tissue (Lisowski et al. Selection and evaluation of clinically relevant AAV variants in a xenograft liver model. Nature 2014 506:382-386, the contents of which are herein incorporated by reference in its entirety) with adenovirus, in order to trigger exponential replication of infectious AAV DNA. Another approach involved the use of cell-specific CRE transgenic mice (Deverman et al. Cre-dependent selection yields AAV variants for widespread gene transfer to the adult brain. Nat Biotechnol. 2016 February 34(2)204-209; the contents of which are herein incorporated by reference in its entirety) allowing viral DNA recombination specifically in astrocytes, followed by recovery of CRE-recombined capsid variants. Other approaches apply high throughput DNA synthesis, multiplexing, sequencing technologies, and machine learning to evaluate sequencing reads of viral DNA in different tissues to engineer variant capsids. These approaches are different from the approach disclosed herein.

There are some limitations to the art-known capsid generation methods. For example, the transgenic CRE system used by Deverman et al. (2016) has limited tractable in other animal species and AAV variants selected by directed evolution in mouse tissue do not show similar properties in large animals. Previously described transduction-specific approaches are not amenable to large animal studies because: 1) many tissues of interest (e.g., CNS) are not readily accessible to adenovirus co-infection, 2) the specific adenovirus tropism itself would bias the library distribution, and 3) large animals are typically not amenable to transgenesis or genetic engineering to express CRE recombinase in defined cell types.

To address these limitations, a broadly-applicable functional AAV capsid library screening platform for cell type-specific biopanning in non-transgenic animals has been developed and is described in the appended Examples. In the TRACER (Tropism Redirection of AAV by Cell type-specific Expression of RNA) platform system, the capsid gene is placed under the control of a cell type-specific promoter to drive capsid mRNA expression in the absence of helper virus co-infection. Without wishing to be bound by theory, it is believed that this RNA-driven screen increases the selective pressure in favor of capsid variants which transduce a specific cell type. The TRACER platform allows for generation of AAV capsid libraries whereby specific recovery and subcloning of capsid mRNA expressed in transduced cells is achieved with no need for transgenic animals or helper virus co-infection. Without wishing to be bound by theory, it is believed that since mRNA transcription is a hallmark of full transduction, the methods disclosed herein allow identification of fully infectious AAV capsid mutants, and in addition to its higher stringency, this method allows identification of capsids with high tropism for particular cell types using libraries designed to express CAP mRNA under the control of any cell-specific promoter such as, but not limited to, synapsin-1 promoter (neurons), GFAP promoter (astrocytes), TBG promoter (liver), CAMK promoter (skeletal muscle), MYH6 promoter (cardiomyocytes). Described herein are novel AAV capsid variants generated using the TRACER method which demonstrate enhance tropism in for example a CNS cell, a CNS tissue, a liver cell, a liver tissue, a muscle cell, or a muscle tissue.

In some embodiments, an AAV capsid variant disclosed herein comprises a modification in loop IV of AAV9, e.g., at positions between 449-460, e.g., at position 454 and/or 455, numbered relative to SEQ ID NO: 138, 981, or 982. In some embodiments, loop (e.g., loop IV) is used interchangeably herein with the term variable region (e.g., variable region IV), or VR (e.g., VR-IV). In some embodiments loop IV comprises positions 449-475 (e.g., amino acids KTINGSGQNQQTLKFSVAGPSNMAVQG (SEQ ID NO: 6404)), numbered according to SEQ ID NO: 138. In some embodiments loop IV comprises positions 449-460 (e.g., amino acids KTINGSGQNQQT (SEQ ID NO: 6405)), numbered according to SEQ ID NO: 138. In some embodiments, loop IV or variable region IV (VR-IV) is as described in DiMattia et al. "Structural Insights into the Unique Properties of the Adeno-Associated Virus Serotype 9," *Journal of Virology*, 12(86):6947-6958 (the contents of which are hereby incorporated by reference in their entirety), e.g., comprising positions 452-460 (e.g., NGSGQNQQT (SEQ ID NO: 4487)), numbered according to SEQ ID NO: 138.

The AAV particles and payloads of the disclosure may be delivered to one or more target cells, tissues, organs, or organisms. In some embodiments, the AAV particles of the disclosure demonstrate enhanced tropism for a target cell type, tissue or organ. As a non-limiting example, the AAV particle may have enhanced tropism for cells and tissues of the central or peripheral nervous systems (CNS and PNS, respectively). In some embodiments, an AAV particle of the disclosure may, in addition, or alternatively, have decreased tropism for a cell-type, tissue or organ.

In some embodiments, an AAV comprises a small non-enveloped icosahedral capsid virus of the Parvoviridae family and is characterized by a single stranded DNA viral genome. Parvoviridae family viruses consist of two subfamilies: Parvovirinae, which infect vertebrates, and Densovirinae, which infect invertebrates. The Parvoviridae family comprises the Dependovirus genus which includes AAV, capable of replication in vertebrate hosts including, but not limited to, human, primate, bovine, canine, equine, and ovine species.

The parvoviruses and other members of the Parvoviridae family are generally described in Kenneth I. Berns, "Parvoviridae: The Viruses and Their Replication," Chapter 69 in FIELDS VIROLOGY (3d Ed. 1996), the contents of which are incorporated by reference in their entirety.

In some embodiments, AAV are used as a biological tool due to a relatively simple structure, their ability to infect a wide range of cells (including quiescent and dividing cells) without integration into the host genome and without replicating, and their relatively benign immunogenic profile. The genome of the virus may be manipulated to contain a minimum of components for the assembly of a functional recombinant virus, or viral particle, which is loaded with or engineered to target a particular tissue and express or deliver a desired payload.

In some embodiments, the AAV, is a naturally occurring (e.g., wild-type) AAV or a recombinant AAV. In some embodiments, the wild-type AAV vector genome is a linear, single-stranded DNA (ssDNA) molecule approximately 5,000 nucleotides (nt) in length. In some embodiments, inverted terminal repeats (ITRs) cap the viral genome at both the 5' and the 3' end, providing origins of replication for the viral genome. In some embodiments, an AAV viral genome typically comprises two ITR sequences. These ITRs have a characteristic T-shaped hairpin structure defined by a self-complementary region (145nt in wild-type AAV) at the 5' and 3' ends of the ssDNA which form an energetically stable double stranded region. The double stranded hairpin structures comprise multiple functions including, but not limited to, acting as an origin for DNA replication by functioning as primers for the endogenous DNA polymerase complex of the host viral replication cell.

In some embodiments, the wild-type AAV viral genome further comprises nucleotide sequences for two open reading frames, one for the four non-structural Rep proteins (Rep78, Rep68, Rep52, Rep40, encoded by Rep genes) and one for the three capsid, or structural, proteins (VP1, VP2, VP3, encoded by capsid genes or Cap genes). The Rep proteins are used for replication and packaging, while the capsid proteins are assembled to create the protein shell of the AAV, or AAV capsid polypeptide, e.g., an AAV capsid variant. Alternative splicing and alternate initiation codons and promoters result in the generation of four different Rep proteins from a single open reading frame and the generation of three capsid proteins from a single open reading frame. Though it varies by AAV serotype, as a non-limiting example, for AAV9/hu.14 (SEQ ID NO: 123 of U.S. Pat. No. 7,906,111, the contents of which are herein incorporated by reference in their entirety) VP1 refers to amino acids 1-736, VP2 refers to amino acids 138-736, and VP3 refers to amino acids 203-736. In some embodiments, for any one of the amino acid sequences of SEQ ID NO: 981 or 982, VP1 comprises amino acids 1-742, VP2 comprises amino acids 138-742, and VP3 comprises amino acids 203-742. In other words, VP1 is the full-length capsid sequence, while VP2 and VP3 are shorter components of the whole. As a result, changes in the sequence in the VP3 region, are also changes to VP1 and VP2, however, the percent difference as compared to the parent sequence will be greatest for VP3 since it is the shortest sequence of the three. Though described here in relation to the amino acid sequence, the nucleic acid sequence encoding these proteins can be similarly described. Together, the three capsid proteins assemble to create the AAV capsid protein. While not wishing to be bound by theory, the AAV capsid protein typically comprises a molar ratio of 1:1:10 of VP1:VP2:VP3.

AAV vectors of the present disclosure may be produced recombinantly and may be based on adeno-associated virus (AAV) reference sequences. In addition to single stranded AAV viral genomes (e.g., ssAAVs), the present disclosure also provides for self-complementary AAV (scAAVs) viral genomes. scAAV vector genomes contain DNA strands which anneal together to form double stranded DNA. By skipping second strand synthesis, scAAVs allow for rapid expression in the transduced cell. In some embodiments, the AAV particle of the present disclosure is an scAAV. In some embodiments, the AAV particle of the present disclosure is an ssAAV.

Methods for producing and/or modifying AAV particles are disclosed in the art such as pseudotyped AAV vectors (PCT Patent Publication Nos. WO200028004; WO200123001; WO2004112727; WO2005005610; and WO2005072364, the content of each of which is incorporated herein by reference in its entirety).

As described herein, the AAV particles of the disclosure comprising an AAV capsid variant, and a viral genome, have enhanced tropism for a cell-type or a tissue, e.g., a CNS cell-type, region, or tissue.

Peptides

Disclosed herein are peptides, and associated AAV particles comprising an AAV capsid variant and a peptide for enhanced or improved transduction of a target tissue (e.g., cells of the CNS or PNS). In some, embodiments, the peptide is an isolated, e.g., recombinant, peptide. In some embodiments, the nucleic acid encoding the peptide, is an isolated, e.g., recombinant nucleic acid.

In some embodiments, the peptide may increase distribution of an AAV particle to a cell, region, or tissue of the CNS. The cell of the CNS may be, but is not limited to, neurons (e.g., excitatory, inhibitory, motor, sensory, autonomic, sympathetic, parasympathetic, Purkinje, Betz, etc.), glial cells (e.g., microglia, astrocytes, oligodendrocytes) and/or supporting cells of the brain such as immune cells (e.g., T cells). The tissue of the CNS may be, but is not limited to, the cortex (e.g., frontal, parietal, occipital, and/or temporal), thalamus, hypothalamus, striatum, putamen, caudate nucleus, hippocampus, entorhinal cortex, basal ganglia, or deep cerebellar nuclei.

In some embodiments, the peptide may increase distribution of an AAV particle to a cell, region, or tissue of the PNS. The cell or tissue of the PNS may be, but is not limited to, a dorsal root ganglion (DRG).

In some embodiments, the peptide may increase distribution of an AAV particle to the CNS (e.g., the cortex) after intravenous administration. In some embodiments, the peptide may increase distribution of an AAV particle to the CNS (e.g., the cortex) following focused ultrasound (FUS), e.g., coupled with the intravenous administration of microbubbles (FUS-MB), or MRI-guided FUS coupled with intravenous administration.

In some embodiments, the peptide may increase distribution of an AAV particle to the PNS (e.g., DRG) after intravenous administration. In some embodiments, the peptide may increase distribution of an AAV particle to the PNS (e.g., DRG) following focused ultrasound (FUS), e.g., coupled with the intravenous administration of microbubbles (FUS-MB), or MRI-guided FUS coupled with intravenous administration.

In some embodiments, the peptide may increase distribution of an AAV particle to a cell, region, or tissue of a muscle. In some embodiments, the muscle is a heart muscle, e.g., a heart atrium or a heart ventricle. In some embodiments, the peptide may direct an AAV particle to a muscle cell, region, or tissue after intravenous administration.

In some embodiments, the peptide may increase distribution of an AAV particle to a cell, region, or tissue of the liver.

A peptide may vary in length. In some embodiments, the peptide is about 3 to about 20 amino acids in length. As non-limiting examples, the peptide may be 3, 4, 5, 6, 7, 8, 9, 10, 11, 12, 13, 14, 15, 16, 17, 18, 19, 20 or 3-5, 3-8, 3-10, 3-12, 3-15, 3-18, 3-20, 5-10, 5-15, 5-20, 10-12, 10-15, 10-20, 12-20, or 15-20 amino acids in length. In some embodiments, a peptide comprises about 6 to 12 amino acids in length, e.g., about 9 amino acids in length. In some embodiments, a peptide comprises about 5 to 10 amino acids in length, e.g., about 7 amino acids in length. In some embodiments, a peptide comprises about 7 to 11 amino acids in length, e.g., about 8 amino acids in length. In some embodiments, a peptide comprises about 4 to 9 amino acids in length, e.g., about 6 amino acids in length.

In some embodiments a peptide may comprise a sequence as set forth in Table 1 (e.g., comprising the amino acid sequence of any one of SEQ ID NOs: 200-940, 1800-2241, 2242-2886, or 2887-3076). In some embodiments a peptide may comprise a sequence as set forth in Table 2A or 2B. In some embodiments, the peptide may comprise a sequence set forth in Table 13 or 14. In some embodiments, the peptide may comprise a sequence as set forth in Table 15. In some embodiments, the peptide may comprise a sequence as set forth in Table 16. In some embodiments, the peptide may comprise a sequence as set forth in Table 17. In some embodiments, the peptide may comprise a sequence as set forth in Table 18. In some embodiments, the peptide may comprise a sequence as set forth in Table 19. In some embodiments, the peptide is isolated, e.g., recombinant.

TABLE 1

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GSGSPHSKAQNQQT | 200 | GSLHHDNHGQNQQT | 385 | GSVFGVPSGQNQQT | 570 | GSIAMTSHGQNQQT | 755 |
| GHDSPHKSGQNQQT | 201 | GIMARDSSGQNQQT | 386 | GSGLPDRNLQNQQT | 571 | GSPGVSPSGQNQQT | 756 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GSGSPHARMQNQQT | 202 | GVVHITNSGQNQQT | 387 | GSGTHNSAIQNQQT | 572 | GSGQNQQTGSSSRV | 757 |
| GSGSPHVKSQNQQT | 203 | GSGQNQHSAPFNQT | 388 | GSGMIIASMQNQQT | 573 | GSGQHLPLLGNQQT | 758 |
| GQDSPHKSGQNQQT | 204 | GSGQTSGLKQNQQT | 389 | GGITWTDSGQNQQT | 574 | GSDHSHRGGQNQQT | 759 |
| GSGSPHASRQNQQT | 205 | GSGQNQQTSLSNTA | 390 | GSGQNQQASGRQQT | 575 | GSGIVTKLGQNQQT | 760 |
| GSGSPHASRQNKQT | 206 | GSGQNQAVHNKSQT | 391 | GSGQNQQPHLKSLT | 576 | GSGQDVTKTGNQQT | 761 |
| GSGSPHVKIQNQQT | 207 | GVHTHLPSGQNQQT | 392 | GPPQHMTSGQNQQT | 577 | GSGQNQQSHGRIGT | 762 |
| GSGSPHSKAKNQQT | 208 | GHLTMHNSGQNHQT | 393 | GSGQNQQASLPSRT | 578 | GSGQNQQINHRSPT | 763 |
| GSGSPHKKNQNQQT | 209 | GSGSSSRPYQNQQT | 394 | GSGQIVSTQTNQQT | 579 | GSGDDSRVGQNQQT | 764 |
| GSGSPHVRMQNQQT | 210 | GILLATPSGQNQQT | 395 | GSGKGHSAGQNQQT | 580 | GSGQSTLKRINQQT | 765 |
| GSGSPHASRQKQQT | 211 | GSGQNAGSFPNQQT | 396 | GSGQNTRLQLGQQT | 581 | GSGSQHSKAQNQQT | 766 |
| GHSSPHRSGQNQQT | 212 | GSRDGHTVGQNQQT | 397 | GSVGSRPVGQNQQT | 582 | GSGQNQQHASSNNT | 767 |
| GMRTYHLSGQNQQT | 213 | GSLLISTSGQNQQT | 398 | GSSHTLALGQNQQT | 583 | GSRTYQVSGQNQQT | 768 |
| GSGSPHTRGQNQQT | 214 | GSGAMPSHGQNQQT | 399 | GMYEYSQSGQNQQT | 584 | GSGQNQGLLSSPQT | 769 |
| GSGIIPVSSQNQQT | 215 | GALVSPISGQNQQT | 400 | GNGQNQQHSILHGT | 585 | GSGGGLQHNQNQQT | 770 |
| GSEYGHKSGQNQQT | 216 | GSLSSHGVGQNQQT | 401 | GSGYNQPHLQNQQT | 586 | GSGQNQQTTAATRM | 771 |
| GRGQNVSSVHRQQT | 217 | GSGQNQQASLAMRT | 402 | GPLVNASSGQNQQT | 587 | GSGQNQRASILVQT | 772 |
| GSSHRFYGGQNQQT | 218 | GPGLGSHSGQNQQT | 403 | GSGQNQQVLTTART | 588 | GSGQNLGLLGAQQT | 773 |
| GYFVAAWSGQNQQT | 219 | GHDSQHKSGQNQQT | 404 | GSGQNQHSVHNDQT | 589 | GSLDLGRSGQNQQT | 774 |
| GSVLHSHAAQNQQT | 220 | GSGLTLSATQNQQT | 405 | GAGLIMHSGQNQQT | 590 | GNSQVKVSGQNQQT | 775 |
| GSGDLVVSTQNQQT | 221 | GSGQVVAHVGNQQT | 406 | GMGRHSASGQNQQT | 591 | GSSGSHQYGQNQQT | 776 |
| GSYGMAASGQNQQT | 222 | GSGLRTMTTQNQQT | 407 | GSHSQSGHGQNQQT | 592 | GSGQNQQQRDGTLT | 777 |
| GLNHFGASGQNQQT | 223 | GSGQVGRLLQNQQT | 408 | GSSTTIVSGQNHQT | 593 | GRGQHVSVANNQQT | 778 |
| GSTGSHSAGQNQHT | 224 | GSGQLSHQSVNQQT | 409 | GRHLVTASGQNQQT | 594 | GDSSSRISGQNQQT | 779 |
| GLAGHTVSGQNQQT | 225 | GSGDRYQTLQNQQT | 410 | GSGQNQQHANLNQT | 595 | GSGQNQHSLSSQQT | 780 |
| GIILGASSGQNQQT | 226 | GSGQNQQLKSSAQT | 411 | GSGSTHSKAQNQQT | 596 | GSLMDVHRGQNQQT | 781 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GSGVSTYNIQNQQT | 227 | GSGQNQYSIPVAQT | 412 | GSGQNKQMLSGNTT | 597 | GSIQYQSSGQNQQT | 782 |
| GSLVSVQTGQNQQT | 228 | GSGERLHLTQNQQT | 413 | GSGQVHNPTQNQQT | 598 | GLGSKNPSGQNQQT | 783 |
| GQSSPHRSGQNQQT | 229 | GSGHNQQVRTAPNT | 414 | GSGQNQQIPHVHQT | 599 | GSGQLVLTLQNQQT | 784 |
| GREYGHKSGQNQQT | 230 | GGLSHVMSGQNQQT | 415 | GSLHAGLSGQNQQT | 600 | GSGQNQQTSQPLPG | 785 |
| GHTLTLSSGQNQQT | 231 | GSGQSHRDVLNQQT | 416 | GPAQHGTSGQNQQT | 601 | GSGQNQQNLGKLNT | 786 |
| GSITLIPSGQNQQT | 232 | GSGQNLAGRMDQQT | 417 | GEKAVTSSGQNQQT | 602 | GTTAHQPSGQNQQT | 787 |
| GSNGFTALGQNQQT | 233 | GSGQNQQTNRGNPM | 418 | GSGQNQQTMANGQR | 603 | GSGQNRAQIGTQQT | 788 |
| GSGHSSHSVQNQQT | 234 | GSGQSYQRDHNQQT | 419 | GSGSPHSKDQNQQT | 604 | GSGQYVHVSSNQQT | 789 |
| GSGIPQRSGKNQQT | 235 | GSLLSAGMGQNQHT | 420 | GSFSMGYGGQNQQT | 605 | GSGQNQQTAHAFNI | 790 |
| GSGDTLHMLQNQQT | 236 | GSGQNQQTAIYRNI | 421 | GSGTHLVSLQNQQT | 606 | GSGQNQRTMVATQT | 791 |
| GERHTVLSGQNQQT | 237 | GSGQNQQTSGTTNC | 422 | GSGQMPHVQNQQT | 607 | GSGQNPIRGAMQQT | 792 |
| GSGMPQSHIQNQQT | 238 | GMTSHSVSGQNQQT | 423 | GSGQNQQVAGLNNT | 608 | GSGYVITGSQNQQT | 793 |
| GSGQLSGIGGNQQT | 239 | GSSQSTGYQPNQQT | 424 | GSSQNQQHDMRLRT | 609 | GRGPKQSNIQNQQT | 794 |
| GSGQNRKPASFAQT | 240 | GSLKPTTLGQNQQT | 425 | GPASLPISGQNQQT | 610 | GSGQNQQTMLGKPC | 795 |
| GSGSVSQLGQNQQT | 241 | GRMFSLGSGQNQQT | 426 | GSGQNQQPPLATRT | 611 | GSGQNQQVGSTVRT | 796 |
| GSDFLGTHGQNQQT | 242 | GSGQNQQTALGVKC | 427 | GSSRVPVSGQNQQT | 612 | GNVTTQKSGQNQQT | 797 |
| GQIVQNPSGQNQQT | 243 | GAMVSHSSGQNQQT | 428 | GSGQNQQTNLGHTT | 613 | GSGNPVSHLQNQQT | 798 |
| GSGTQIPSQQNQQT | 244 | GSGQNQQRNSDSVT | 429 | GSGQNQQLVSRVQT | 614 | GSLSHMESGQNQQT | 799 |
| GSGQNQQSAREGLT | 245 | GSGQSMTLHLNQQT | 430 | GPNSYPVSGQKQQT | 615 | GRAPTNLSGQNQQT | 800 |
| GSGLGMSTGQNQQT | 246 | GSGQVHQAEVNQQT | 431 | GHAHYQASGQNQQT | 616 | GSGQNQQTVMTARA | 801 |
| GSGLPVLSGQNQQT | 247 | GSGQNQSQNHLQQT | 432 | GSGQALLSTGNQQT | 617 | GSGMPASRLQNQQT | 802 |
| GSGHSIRTDQNQQT | 248 | GSLLTTASGQNQQT | 433 | GSGQLPRQMTNQQT | 618 | GVVRNHQSGQNQQT | 803 |
| GSGQSVQTVVNQQT | 249 | GSGLIRTAAQNQQT | 434 | GSGFPKSTEQNQQT | 619 | GSGQNQHSVQVRQT | 804 |
| GSGQNRAQSRFQQT | 250 | GSGQNQQTVSRQST | 435 | GSRETSLSGQNQQT | 620 | GSGQNTGHLTMQQT | 805 |
| GGGDLGRSSQNQQT | 251 | GSGQYANHGINQQT | 436 | GSGQNQQGTGVSHT | 621 | GSGQNQQYAGKILT | 806 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GGGTKMDSGNQQT | 252 | GSRSTGPSGQNQQT | 437 | GSRTVPVYGQNQQT | 622 | GSGNPHVRNQNQQT | 807 |
| GSGSPHPSRQNQT | 253 | GRGVQQKLQQNQQT | 438 | GSNAQSAHGQNQQT | 623 | GSGQNGGSSNRQQT | 808 |
| GSGQFTNAGMNQQT | 254 | GSGQNQQVHLSTGT | 439 | GAFHLAASGQNQQT | 624 | GSGQRLSQGVNHQT | 809 |
| GGRNGHTVGQNQQT | 255 | GSGQNQQLSAKSST | 440 | GSGQYRSSSDNQQT | 625 | GSGQNAHAKEGQQT | 810 |
| GSGFGPQTGQNQQT | 256 | GSGYKAARPQNQQT | 441 | GSGQVYISTPNQQT | 626 | GSSPAPNSGQNQQT | 811 |
| GRTDSHTSGQNQQT | 257 | GSAGISPSGQNQQT | 442 | GSGVSTQLLQNQQT | 627 | GLAHKTSSGQNQQT | 812 |
| GYEVLGSSGQNQQT | 258 | GSGQNRAHAFLQQT | 443 | GSGQLGLSVTNQQT | 628 | GSGQNQQTPGAHKT | 813 |
| GSVHLSVTGQNQQT | 259 | GSGLSGITMQNQQT | 444 | GSGSNMRLSQNQQT | 629 | GSGQNQQSLSGSFT | 814 |
| GFMSYKGSGQNQQT | 260 | GPGSAHSSGQNQQT | 445 | GSGQNLHSGLPQQT | 630 | GSGQNQQSTGTSRT | 815 |
| GNIAGSVSGQNQQT | 261 | GSSHTQALGQNQQT | 446 | GSSHTLALGQNKQT | 631 | GSGQNQQTVQSNLV | 816 |
| GSGSHRDVSQNQQT | 262 | GSGVHGVSSQNQQT | 447 | GSGQNQHSLPAHRT | 632 | GSGQNQQLGSRQCT | 817 |
| GGLGSMSSGQNQQT | 263 | GSSGRDMGGQNQQT | 448 | GSGQNQGTVYPNQT | 633 | GSGQNQYLRLELQT | 818 |
| GSGHLPQSAQNQQT | 264 | GERAFPTSGQNQQT | 449 | GSGQNQQPSLRQST | 634 | GSGQNQQTSPRLQT | 819 |
| GGVLVGGSGQNQQT | 265 | GGRIVSLSGQNQQT | 450 | GSGQNARLKDNQQT | 635 | GSGQNQQTTSSNMT | 820 |
| GTHPYTSSGQNQQT | 266 | GSGQNSYSHTSQQT | 451 | GHAGSTGSGQNQQT | 636 | GTASTYNSGQNQQT | 821 |
| GSGQNQQLKENRST | 267 | GLGYPGSSGQNQQT | 452 | GSGQALSSSGNQQT | 637 | GSGQNQQTMPQHKI | 822 |
| GSGQNQQTSPHNHT | 268 | GSGPQSHTGQNQQT | 453 | GSGASESHRQNQQT | 638 | GSGQSHLHTGNQQT | 823 |
| GSGTLYPQSQNQQT | 269 | GSGQNQQLSRDAST | 454 | GVGVITSSGQNQQT | 639 | GVKGVGHSGQNQQT | 824 |
| GSGQNQQSNWITKT | 270 | GSGQILHSVPNQQT | 455 | GSLYGQSLGQNQQT | 640 | GSGKVTKQSQNQQT | 825 |
| GSGYTSLFLQNQQT | 271 | GSGFHTDSRQNQQT | 456 | GSGQMSDVHGNQQT | 641 | GSGQNQQTALEKSL | 826 |
| GSGVMTHVLQNQQT | 272 | GSGQSHSLATNQQT | 457 | GSGQNQQHSSKATT | 642 | GSGYKDTYGQNQQT | 827 |
| GSVSDVRAGQNQQT | 273 | GSGQNQQTLSKPWT | 458 | GSGQNQQTSVSQQT | 643 | GSGQNQQSGTFLST | 828 |
| GSGQSHMATLNQQT | 274 | GSGHAAISQQNQQT | 459 | GSGQKMWKLDNQQT | 644 | GSGQNTGQHMMQQT | 829 |
| GSGLSVHLAQNQQT | 275 | GSGQNQQQIGGNST | 460 | GSGQNVSMQVNQQT | 645 | GSGKNQQRPGLDQT | 830 |
| GSGLSHATQQNQQT | 276 | GGGPMAGSGQNQQT | 461 | GSGQNQRATLSNQT | 646 | GSGQSREISLNQQT | 831 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GSGLSVQSGNQQT | 277 | GMRMEYQSGQNQQT | 462 | GSGQASSKSANQQT | 647 | GTPTSPSSGQNQQT | 832 |
| GSGHMTYREKNQQT | 278 | GSGQNQQGTLLHQT | 463 | GSGKNQTPIPKGQT | 648 | GKPAGGLSGQNQQT | 833 |
| GSKGVPTPGQNQQT | 279 | GSGQNQRSSGGVQT | 464 | GSGQNQQTRQEGST | 649 | GSGQNHRSADMQQT | 834 |
| GSGLLPLSSQNQQT | 280 | GSGQNQRGALATQT | 465 | GASSLATSGQNQQT | 650 | GSGQNQQTLPSLSL | 835 |
| GNGLYAVSGQNQQT | 281 | GSGTVHAATQNQQT | 466 | GSGQRGSLTENQQT | 651 | GSPYMGATGQNQQT | 836 |
| GFNGSPSSGQNQQT | 282 | GSRMTQQFGQNQQT | 467 | GSEQTRQRGQNQQT | 652 | GSGHAKAVGQNQQT | 837 |
| GSGQIRHSDQNQQT | 283 | GSSSPGASGQNQQT | 468 | GSGQNQQTLTASKE | 653 | GHMKGVTSGQNQQT | 838 |
| GGQVAPSSGQNQQT | 284 | GHPSPHVSGQNQQT | 469 | GSGTSGKTGKNQQT | 654 | GSGQNQKILTLDQT | 839 |
| GSFSMHTHGQNQQT | 285 | GSGSHHASRQNQQT | 470 | GQLVTFTSGQNQQT | 655 | GSGQNQQTKVGHSA | 840 |
| GSGQNQQVIQGSNT | 286 | GAVGHSYSGQNQQT | 471 | GSGQNQQSANKILT | 656 | GIARTTISGQNQQT | 841 |
| GRVLHSHAGQNQQT | 287 | GSRSQYDIGQNQQT | 472 | GSGQNQQHHSSHTT | 657 | GSGQNQQTSVGFRT | 842 |
| GSGQNQQTSLQDQT | 288 | GSGQGPQERGNQQT | 473 | GSGQNQKGMQPNQT | 658 | GSGQNQQTMIANIR | 843 |
| GSGLGRAPVQNQQT | 289 | GSIAHVGTGQNQQT | 474 | GSGQLVSGLYNQQT | 659 | GDMTRSSSGQNQQT | 844 |
| GNGFSSASGQNQQT | 290 | GSGQNQQKQNHGNT | 475 | GSSVGVPSGQNQQT | 660 | GSGHMSDLRQNQQT | 845 |
| GSGQMASRESNQQT | 291 | GSGQNQQALGSQRT | 476 | GSGQNQQWDSRRQT | 661 | GRGAVMASGQNQQT | 846 |
| GPGLPNHSGQNQQT | 292 | GSGAITHMPQNQQT | 477 | GSEQTRQSGQNQQT | 662 | GSGQNQQLSGKSVT | 847 |
| GNIQWQGSGQNQQT | 293 | GSGQRNPLLLNQQT | 478 | GSGIGSHIPQNQQT | 663 | GSHTLVVSGQNQQT | 848 |
| GMSAHMSSGQNQQT | 294 | GSSGIPVSHQNQQT | 479 | GSGQNQRLHGVDQT | 664 | GSGPWSAGLQNQQT | 849 |
| GHSFVNRSGQNQQT | 295 | GVHSLTPSGQNQQT | 480 | GEVSRVLSGQNQQT | 665 | GSGQHSPHALNQQT | 850 |
| GRAVMDHSGQNQQT | 296 | GVIVLHGSGQNQQT | 481 | GSGQNQQKVSPLLT | 666 | GSGQNQQPNSGSMT | 851 |
| GALTVMQSGQNQQT | 297 | GGTRVVDSGQNQQT | 482 | GSGLALERSQNQQT | 667 | GSGLAHLGGQNQQT | 852 |
| GSGQRSPVLPNQQT | 298 | GSGGVTYQSGNQQT | 483 | GPDRIGSSGQNQQT | 668 | GSSVRYEPKQNQQT | 853 |
| GSGQNGHLSLKQQT | 299 | GSGQNQAGHGPGQT | 484 | GSGQNQDHQNKQQT | 669 | GSGQNQQARPLELT | 854 |
| GSLPRGTSDQNQQT | 300 | GSGQLVTSGPNQQT | 485 | GSGQNQQTALYNNT | 670 | GSGQPRSTGINQQT | 855 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GVAGSLVSGQNQQT | 301 | GSGIAAQRTQNQQT | 486 | GSGAVHLTAQNQQT | 671 | GSGQNQANWVKVQT | 856 |
| GRGGIPQSGQNQQT | 302 | GSTPAGVGGQNQQT | 487 | GSLVSTQSGQNQQT | 672 | GSGHLFQSGQNQQT | 857 |
| GSGQYASSIPNQQT | 303 | GSGQNQQTSTGVHS | 488 | GSGVSARMVQNQQT | 673 | GSGQNRGISISQQT | 858 |
| GTDFGRQSSQNQQT | 304 | GSGQIRQLVDNQQT | 489 | GSGQTRMPLANQQT | 674 | GSGTHYDNRQNQQT | 859 |
| GIFMQTPSGQNQQT | 305 | GSLIGMQSGQNQQT | 490 | GSGISSRNMQNQQT | 675 | GSGQNQQTSTTPLP | 860 |
| GSGQNQQTRLVDLT | 306 | GSGQIKGKMDNQQT | 491 | GSGEKVHSGQNQQT | 676 | GSGQVHASQVNQKT | 861 |
| GTREMPLSGQNQQT | 307 | GSGSDMSSWQNQQT | 492 | GSGQNQQKLSSMST | 677 | GSSGHRESGQNQQT | 862 |
| GSRLVHVHGQNQQT | 308 | GRGQNQQHTGLATT | 493 | GSGQNQQTGQHMRV | 678 | GLSAEKSSGQNQQT | 863 |
| GSGRLVPNGPNQQT | 309 | GSGQNQQTLYSSNT | 494 | GSGMIHTTAQNQQT | 679 | GSGQEHRSLANQQT | 864 |
| GSGYLRESPQNQQT | 310 | GSGQTQVLKSNQQT | 495 | GSGQNWPALKGQQT | 680 | GSGQTVVRIANQQT | 865 |
| GARIQNASGQKQQT | 311 | GSRTLSNVGQNQQT | 496 | GASHMSISGQNQQT | 681 | GSGQNVSSVHRQQT | 866 |
| GLSNPMPSGQNQQT | 312 | GSGVQHSLPQNQQT | 497 | GSDQNQQLGYSKQT | 682 | GSGASRMSIQNQQT | 867 |
| GSTVQDTRGQNQQT | 313 | GNYLHQASGQNQQT | 498 | GIPSIRESGQNQQT | 683 | GVAFIGSSGQNQQT | 868 |
| GPFGMPSSGQNQQT | 314 | GSGGTSVHQQNQQT | 499 | GSGIPSVKFQNQQT | 684 | GSGQNQQTVPTRQT | 869 |
| GSGQNHGVLSNQQT | 315 | GMDHSRPSGQNQQT | 500 | GSGQNQQTSVSQNV | 685 | GSGQAAKSSQNQQT | 870 |
| GSGYSMSQAQNQQT | 316 | GSGQNQQSMGTFTT | 501 | GSGQNQQIGESRMT | 686 | GSGQNQQVAIRTST | 871 |
| GSGMLTHTLQNQQT | 317 | GSGQNQQTPLRPPT | 502 | GSGSSSMSFQNQQT | 687 | GSVHMQNAGQNQQT | 872 |
| GRGSPHASRQNQQT | 318 | GSGQNQHHSVSQQT | 503 | GSGQKQERAVSKQT | 688 | GSGMRQAGVQNQQT | 873 |
| GLSWPSTSGQNQQT | 319 | GSGQLRSLSTNQQT | 504 | GCTTRLNSGQNQQT | 689 | GSGQNQQVGGKTVT | 874 |
| GNSMERTSGQNQQT | 320 | GSGSPRQLSQNQQT | 505 | GSGQNQQIISTKIT | 690 | GVHDMRVSGQNQQT | 875 |
| GSGMSPSTLQNQQT | 321 | GSGQNQQTTASSHT | 506 | GSGQNQQKSLNGNT | 691 | GSGQHVSVANNQQT | 876 |
| GSGHGQVLSQNQQT | 322 | GRGQVVSTHQNQQT | 507 | GSGIPAPRLQNQQT | 692 | GSAAMSVRGQNQQT | 877 |
| GRGQIYSTGGNQQT | 323 | GSAQVSMVGQNQQT | 508 | GSGQIRESMGNQQT | 693 | GVSRGGPSGQNQQT | 878 |
| GVVAAHNSGQNQQT | 324 | GSSTLVTIGKNQQT | 509 | GSGQNSGVHFNQQT | 694 | GSGQMVHTIGNQQT | 879 |
| GDSSLRHSGQNQQT | 325 | GFAHQASSGQNQQT | 510 | GSGQNIGHSLPQQT | 695 | GRGGSMAETQNQQT | 880 |

TABLE 1-continued

Exemplary Peptide Sequences

| Peptide Sequence | SEQ ID NO: | Peptide Sequence | SEQ ID NO: | Peptide Sequence | SEQ ID NO: |
|---|---|---|---|---|---|
| GSLVSQGAGQNQQT | 326 | GSGQPVLSISNQQT | 511 | GSGERSISVQNQQT | 696 | GSGHTNPTRQNQQT | 881 |
| GSLLQAHSGQNQQT | 327 | GSGQSHRSELNQQT | 512 | GSGLKPNVLQNQQT | 513 | GSGEAARYEQNQQT | 882 |
| GSGHIYVGIQNQT | 328 | GSSVGSPIGQNQT | 513 | GSGQVAYAQGNQQT | 698 | GSGQNERHLVLQQT | 883 |
| GHHTTVQSGQNQQT | 329 | GSGMPIRNVQNQQT | 514 | GSGQSSYGSGNQQT | 699 | GSGQNQQSKQQVLT | 884 |
| GSRQSKRNELNQQT | 330 | GSSTRVDSGQNQQT | 515 | GSGQNQAMTHGDQT | 700 | GSGQARAHRGNQQT | 885 |
| GSGQNQQHVSSPRT | 331 | GSGQNQQTAMRSTT | 516 | GSGQNQALVSMGQT | 701 | GSGQNQQPLDTSRT | 886 |
| GSSKELLWGQNQQT | 332 | GSGQNQQHSSSHLT | 517 | GSGQNPSFMRGQQT | 702 | GSGQNQQLANMVTT | 887 |
| GSLSTPSSGQNQT | 333 | GSRNGHAVGQNQQT | 518 | GSGQNQQSHLRTNT | 703 | GSGQMKDLHRNQQT | 888 |
| GSIGYAGQGQNQQT | 334 | GLGAYQSSGQNQQT | 519 | GYTRLETSGQNQQT | 704 | GSGQNQHLSSFVQT | 889 |
| GSGQNQRVSNSQQT | 335 | GPGLSGHSGQNQQT | 520 | GSGQSYDMRGNQQT | 705 | GSGQNQQPSSRVTT | 890 |
| GSGYASHVQQNQQT | 336 | GSTGIVSSGQNQT | 521 | GSRTTQDIGQNQQT | 706 | GSGQNQQLAITLGT | 891 |
| GSGEYSRSGQNQQT | 337 | GSRTTQVIGQNQT | 522 | GSGHPYKAAQNQQT | 707 | GSGQNQQTVGNPAT | 892 |
| GSVSTHSSGQNQQT | 338 | GSGLLHRAQQNQQT | 523 | GRLSNAHGGQNQQT | 708 | GSGQNQGRAHPMQT | 893 |
| GSGQNQHSLGNYQT | 339 | GSGQNAQQAAAQQT | 524 | GSGQNQRAVLNDQT | 709 | GSGQLIASVVNQQT | 894 |
| GSGGLDTRGQNQQT | 340 | GSGQNQQSALRTQT | 525 | GGSHTYGGGQNQQT | 710 | GSSVRSLVGQNQQT | 895 |
| GNILHATSGQNQQT | 341 | GSGFLSDTRQNQQT | 526 | GSSVNSMIGQNQQT | 711 | GGAGSAHSGQNQQT | 896 |
| GSGQSYTMTQNQQT | 342 | GSGLLYHDQQNQQT | 527 | GNSSMMGSGQNQQT | 712 | GSDQNQQTMSSTRT | 897 |
| GSGQNQHSAPNSQT | 343 | GSGQNQHYSLHKQT | 528 | GNRDRPSSGQNQQT | 713 | GSGQNQQMAGAFRT | 898 |
| GSGQNQQTMDHNRT | 344 | GSGHSPLPQQNQQT | 529 | GSGNMHASRQNQQT | 714 | GSLGNLQRGQNQQT | 899 |
| GSNGGVGTGQNQQT | 345 | GNGHSMRPNQNQQT | 530 | GFIFPKVSGQNQQT | 715 | GSGPSISHGQNQQT | 900 |
| GAGSIIPSGQNQT | 346 | GSGLKWSTLQNQQT | 531 | GSGQNQQLKNSTST | 716 | GSGQNQQSSFNVQT | 901 |
| GSGQTHGGQHNQQT | 347 | GSGQMGRQAVNQQT | 532 | GSGQNQQSQYMPRT | 717 | GSGQNQQTGQATHN | 902 |
| GSNLSFQSGQNQQT | 348 | GSGQNQQTSGVLTL | 533 | GSGQRMADIGNQQT | 718 | VSGSPHSKAQNQQT | 903 |
| GATLQVHSGQNQQT | 349 | GSGQNQQALHNPHT | 534 | GSGQNQSHYPSQQT | 719 | CSGSPHSKAQNQQT | 904 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GSGFNQRSEQNQQT | 350 | GSGQNQQVIPNSKT | 535 | GSDGKMHRGQNQQT | 720 | GSGSPHRKAQNQQT | 905 |
| GSGSLRDFDQNQQT | 351 | GSPLQDRVGQNQQT | 536 | GSGSVGFIGQNQQT | 721 | GRGSPHSKAQNQQT | 906 |
| GSGDSITGKQNQQT | 352 | GSGQNQYSSTNPQT | 537 | GLHGMTLSGQNQQT | 722 | GSGSPHSKAQNKQT | 907 |
| GSGQDRNIVQNQQT | 353 | GAMTVTISGQNQQT | 538 | GSDQSKRGDSNQQT | 723 | GSGSPHSKAQTQQT | 908 |
| GSGLSHSHQQNQQT | 354 | GSGQNQQLQTLIRT | 539 | GSLFLATGGQNQQT | 724 | GSGSTHASRQNQQT | 909 |
| GSGQNQQTGMSSVK | 355 | GSGLRQTSQNQQT | 540 | GSGQNQQPSAFSKT | 725 | GSGSPHKYGQNQQT | 910 |
| GSVTHGISGQNQQT | 356 | GSGQNQQTGLRQQT | 541 | GSGQLPQSGLNQQT | 726 | GSGSPHKFGQNQQT | 911 |
| GVVAHQPSGQNQQT | 357 | GSGQTRQMKDNQQT | 542 | GSGSKQNALQNQQT | 727 | VSGSPHKFGQNQQT | 912 |
| GSGPILGQLQNQQT | 358 | GSGQNHGLQSGQQT | 543 | GSGRRELSQNQQT | 728 | GSGSPHSKAQNHQT | 913 |
| GSGHVPNSGLNQQT | 359 | GSGQSHRQPENQQT | 544 | GSGQREPKASNQQT | 729 | GSGSPHSKAQHQQT | 914 |
| GDAGVRSSGQNQQT | 360 | GSGQDRHIVQNQQT | 545 | GSGQNQQHPSTQQT | 730 | GSGSPHKTYQNQQT | 915 |
| GSGSQLMSLQNQQT | 361 | GSGQNQQLPHSNLT | 546 | GSQSTLGLGQNQQT | 731 | VSGSPHASRQNQQT | 916 |
| GSGLDYSQRQNQQT | 362 | GSGQLSVPYDNQQT | 547 | GSGQNQQMPGLSST | 732 | GSGSPHKFGKNQQT | 917 |
| GSGQSSGRLINKQT | 363 | GSGRNPQTQPLQQT | 548 | GSGQNQQTVGGKNL | 733 | GSGSPHASRQNQHT | 918 |
| GSSVSPSSGQNQQT | 364 | GSGQPYSTGLNQQT | 549 | GSSREFHSGQNQQT | 734 | GSHSPHKSGQNQQT | 919 |
| GSGQVVGLSGNQQT | 365 | GSGQNQQTHGGLRD | 550 | GSGQNQQTVPSNLV | 735 | GSGQNQQRRMSPST | 920 |
| GSNMGVPLGQNQQT | 366 | GAYGMVSSGQNQQT | 551 | GSGQNAYSSQAQQT | 736 | GSGSPHSKPQNQQT | 921 |
| GSFYPSSTGQNQQT | 367 | GSGIQSSYSQNQQT | 552 | GSGQNKDHSTRRQT | 737 | GSGSPHKFGQKQQT | 922 |
| GSGQNQQTRLTDLT | 368 | GPRLSDQSGQNQQT | 553 | GQLGSVGSGQDQQT | 738 | VSGSPHGARQNQQT | 923 |
| GPTNGRSSGQNQQT | 369 | GSGQNQQTHPSPCT | 554 | GSGQHAAPGHNQQT | 739 | GSGSPHSKAQKQQT | 924 |
| GSGLLHGKLQNQQT | 370 | GSGQSFQMHTNQQT | 555 | GSGQNQQTSQSPPT | 740 | GSHSPHKRGQNQQT | 925 |
| GANMGHVSGQNQQT | 371 | GSGQNQQTGNPKHT | 556 | GSGNYRDHEQNQQT | 741 | GSGQNRQRLKGLET | 926 |
| GSGQNQQSGRGDLT | 372 | GFSSAVHSGQNQQT | 557 | GSGHSNQHVNQQT | 742 | GSGSPHKLGQNQQT | 927 |
| GSHGHYASGQKQQT | 373 | GSGQNQQTSMSNAT | 558 | GSGQTARNGINQQT | 743 | GSGSPHKTSKNQQT | 928 |
| GSGDLRISPQNQQT | 374 | GSGQDMKQHHNQQT | 559 | GSGQNQQHYGSQGT | 744 | GSGSPHKIGQNQQT | 929 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GSGMPVILGQNQQT | 375 | GLRLSTPSGQNQT | 560 | GSGSPQASRQNQQT | 745 | GSGQDSPHVRNQQT | 930 |
| GRGVITSSGQNHQT | 376 | GSGQNQQTSVYMNT | 561 | GSGFSHSMGKNQQT | 746 | GSGSPHKTSQNQQT | 931 |
| GSGHSVSGPQNQQT | 377 | GSGQNQYSQSSMQT | 562 | GSGQSHSLETNQQT | 747 | GSGSPHASRKNQQT | 932 |
| GSRNGHTVGRNQQT | 378 | GSGQNQQSMADHTT | 563 | GTEQTRQSGQNQQT | 748 | GSHSPHKSGQKQQT | 933 |
| GAGVHMVSGQNQQT | 379 | GWERSFVSGQNQQT | 564 | GSGRHLASVQNQQT | 749 | GSGSPHKTSQKQQT | 934 |
| GSGQNHRPSVLQQT | 380 | GLLAGKSSGQNQQT | 565 | GLGSKNHSGQNQQT | 750 | GSGSPHVRGQNKQT | 935 |
| GSGSPRDSIQNQQT | 381 | GKSFVPQSGQNQQT | 566 | GSGQNQQTSHFPSA | 751 | GSGSPHKTTQNQQT | 936 |
| GSGQGIHSSVNQQT | 382 | GSGQMQSAGSNQQT | 567 | GSGQLSGTPQNQQT | 752 | GSGPVRALRQNQQT | 937 |
| GSGQQLSITPNQQT | 383 | GSDQNQRLTSSMQT | 568 | GSGQNQQAPHKKET | 753 | GSGSPHVRGQKQQT | 938 |
| GGYHSQTSGQNQQT | 384 | GESRAVLSGQNQQT | 569 | GSGQNQQTLRGSLE | 754 | CSGSPHKTSQNQQT | 939 |
| CSHSPHKSGQNQQT | 940 | DAGSPHSKAQNQQ | 1909 | GSGSPHASRQNQQ | 2019 | GNDSPHKSVQNQQ | 2129 |
| GHDSPHKSGQNQQ | 1800 | GSGSPHSKGQNQQ | 1910 | GSGSPHASRQNKQ | 2020 | GHDSPHKSAQNYQ | 2130 |
| GSGSPHSKAQNQQ | 1801 | DGGSPHSKAQNQQ | 1911 | GSGSPHVKIQNQQ | 2021 | GSASPHSKALNQQ | 2131 |
| GSGSPHSKAQNRH | 1802 | ASGSPHSKAHNQQ | 1912 | GSGSPHSKAKNQQ | 2022 | GHESPHKSAQNRQ | 2132 |
| GSGSPHSKVQNQQ | 1803 | GSGSPHSKAQNTY | 1913 | GSGSPHKKNQNQQ | 2023 | GQDSPHKIGQNQQ | 2133 |
| MSGSPHSKAQNQQ | 1804 | GSGSPHSKSQNQH | 1914 | GSGSPHVRMQNQQ | 2024 | GHDSPHKSGQNHL | 2134 |
| GRGSPHSKAQNQQ | 1805 | GGGSPHSKAQDKQ | 1915 | GSGSPHASRQKQQ | 2025 | GHDSPHKSGQYQH | 2135 |
| RNGSPHSKAQNQQ | 1806 | GSGSPHSKAQNHL | 1916 | GHSSPHRSGQNQQ | 2026 | GNDSPHKSVQNHQ | 2136 |
| GSGSPHSKARDQQ | 1807 | GSGSPHSKAQIGM | 1917 | GSGSPHTRGQNQQ | 2027 | GHDSPHKSGQNQW | 2137 |
| GSGSPHSKAPNLQ | 1808 | GSGSPHSKALNKQ | 1918 | CSGSPHSKAQNQQ | 2028 | GHDSPHKSVQNQH | 2138 |
| TSGSPHSKAQNQQ | 1809 | GGGSPHSKAQNPQ | 1919 | GSGSPHRKAQNQQ | 2029 | GHDSPHKSGQNQH | 2139 |
| GSGSPHSKAHVRQ | 1810 | GTGSPHSKAPNQL | 1920 | GSGSPHSKAQNKQ | 2030 | GHDSPHKSGQTRQ | 2140 |
| GSGSPHSKAPNQH | 1811 | GSGSPHSKAQLQQ | 1921 | GSGSPHSKAQTQQ | 2031 | GHDSPHKSGQNLH | 2141 |
| ISGSPHSKAQNQQ | 1812 | GGGSPHSKAQYQQ | 1922 | CSGSPHKTSQNQQ | 2032 | GHDSPHKSAQNQE | 2142 |
| GPGSPHSKAHNQQ | 1813 | GGGSPHSKAQHQQ | 1923 | CSHSPHKSGQNQQ | 2033 | GHDSPHKSGQHLQ | 2143 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GSGSPHSKTQSQQ | 1814 | GSGSPHSKAQRMS | 1924 | GQSSPHRSGQNQQ | 2034 | GHDSPHKSRLNQP | 2144 |
| ESGSPHSKAQNQQ | 1815 | GSGSPHSKAQGIL | 1925 | GRGSPHASRQNQQ | 2035 | GQDSPHKSGQNQD | 2145 |
| GSGSPHSKAQPAK | 1816 | GSGSPHSKAQDRQ | 1926 | GSGSPHASRKNQQ | 2036 | GHDSPHKSGRNQQ | 2146 |
| SSGSPHSKAQNQQ | 1817 | GSGSPHSKARDWQ | 1927 | GSGSPHASRQNQH | 2037 | GHDSPHKSGQNLL | 2147 |
| GNGSPHSKAQNQQ | 1818 | GSGSPHSKAQNTH | 1928 | GSGSPHKFGKNQQ | 2038 | GHDSPHKSGQLVI | 2148 |
| GSGSPHSKSQTQQ | 1819 | GSGSPHSKAQERS | 1929 | GSGSPHKFGQKQQ | 2039 | GHDSPHKSRQSQQ | 2149 |
| ASGSPHSKAQNQQ | 1820 | GSGSPHSKAQNYQ | 1930 | GSGSPHKFGQNQQ | 2040 | GHDSPHKSGRTQE | 2150 |
| GSGSPHSKAQNLA | 1821 | GSGSPHSKAQRTC | 1931 | GSGSPHKIGQNQQ | 2041 | GHDSPHSVQTHQ | 2151 |
| GSGSPHSKSQNQL | 1822 | GSGSPHSKAQIGH | 1932 | GSGSPHKLGQNQQ | 2042 | GHDSPHKSGQNQP | 2152 |
| NSGSPHSKAQNQQ | 1823 | GSGSPHSKAQGAI | 1933 | GSGSPHKTSKNQQ | 2043 | GHDSPHKSGQTQQ | 2153 |
| GSGSPHSKAQGQQ | 1824 | GSGSPHSKAQVPP | 1934 | GSGSPHKTSQKQQ | 2044 | GPDSPHKIGQNQQ | 2154 |
| VSGSPHSKAQNQQ | 1825 | GSGSPHSKAQVQQ | 1935 | GSGSPHKTSQNQQ | 2045 | GHDSPHSVQNQQ | 2155 |
| GSGSPHSKALNRQ | 1826 | GSGSPHSKALMRQ | 1936 | GSGSPHKTTQNQQ | 2046 | GHDSPHKSRQDQH | 2156 |
| LSGSPHSKAQNQQ | 1827 | GSGSPHSKAQYSV | 1937 | GSGSPHKTYQNQQ | 2047 | GPDSPHKSGQKQQ | 2157 |
| GSGSPHSKAHNQQ | 1828 | GSGSPHSKVPNLQ | 1938 | GSGSPHKYGQNQQ | 2048 | GHDSPHKSRQSQH | 2158 |
| GSGSPHSKTQNQQ | 1829 | GSGSPHSKAQAIT | 1939 | GSGSPHSKAQHQQ | 2049 | GHDSPHSVQNQL | 2159 |
| GGGSPHSKAQTQQ | 1830 | GSGSPHSKAQKTL | 1940 | GSGSPHSKDQNQQ | 2050 | GYDSPHKSGQYQH | 2160 |
| GSGSPHSKAQNPP | 1831 | GSGSPHSKAQNQW | 1941 | GSGSPHSKPQNQQ | 2051 | GHDSPHKSRQNQQ | 2161 |
| GSGSPHSKAQNLQ | 1832 | GSGSPHSKAQLHH | 1942 | GSGSPHVRGQKQQ | 2052 | GHDSPHKSWVRQQ | 2162 |
| GGGSPHSKAQNQQ | 1833 | GSGSPHSKAQNII | 1943 | GSGSPHVRGQNKQ | 2053 | GHESPHKSGQNQH | 2163 |
| GSGSPHSKAQYQQ | 1834 | MEGSPHSKAQNQQ | 1944 | GSHSPHKRGQNQQ | 2054 | GHDSPHKIGHNQQ | 2164 |
| GGGSPHSKAQNKQ | 1835 | GSGSPHSKAQGHH | 1945 | GSHSPHKSGQKQQ | 2055 | GHDSPHKSNAWQQ | 2165 |
| GSGSPHSKAQDQE | 1836 | GSGSPHSKAQSKV | 1946 | GSHSPHKSGQNQQ | 2056 | GHDSPHKSGQSVP | 2166 |
| KSGSPHSKAQNQQ | 1837 | GSGSPHSKAQLPS | 1947 | VSGSPHASRQNQQ | 2057 | GHESPHKSGQNIQ | 2167 |
| GGGSPHSKAQNQL | 1838 | GSGSPHSKAIGKQ | 1948 | VSGSPHGARQNQQ | 2058 | GHDSPHSVQNHL | 2168 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GSGSPHSKAQNHQ | 1839 | GGGSPHSKSQNQQ | 1949 | VSGSPHKFGQNQQ | 2059 | GHDSPHKIGLDQQ | 2169 |
| GSGSPHSKAQDQQ | 1840 | GSGSPHSKAQAIH | 1950 | GSGSPHSKAQYYV | 2060 | ASGSPHSKAQHQQ | 2170 |
| GGGSPHSKSQNQL | 1841 | GSGSPHSKAQHGL | 1951 | GSGSPHSKLRRQQ | 2061 | GHDSPHKRGPDQQ | 2171 |
| GNGSPHSKAQNKQ | 1842 | GSGSPHSKAQFMC | 1952 | GSGSPHSKAGCGQ | 2062 | GMGSPHSKTQNQQ | 2172 |
| GSGSPHSKGHWQQ | 1843 | VSGSPHSKAQGQQ | 1953 | GSGSPHSRAQNQQ | 2063 | GHDSPHKSGESQQ | 2173 |
| GSGSPHSKAPNQQ | 1844 | GGGSPHSKAQNQM | 1954 | GSGSPHSKRLRQQ | 2064 | GHDSPHKHGQNHQ | 2174 |
| GSGSPHSKAQNQL | 1845 | GSGSPHSKAQHLQ | 1955 | GSGSPHSLRRNQQ | 2065 | GTGSPHSKAQNQL | 2175 |
| GSGSPHSKRPEQQ | 1846 | ENGSPHSKAQNQQ | 1956 | GSGSPHSRGRNQQ | 2066 | GHDSPHKSVQNKQ | 2176 |
| GSGSPHSKAQRTM | 1847 | GSGSPHSKTQNHQ | 1957 | GSGSPHSSRRNQQ | 2067 | GQVSPHKSGQNQQ | 2177 |
| GNGSPHSKAQNQH | 1848 | GSGSPHSKAQPAR | 1958 | GSGSPHSKAFRLQ | 2068 | GHDSPHKSGQRQL | 2178 |
| HSGSPHSKAQNQQ | 1849 | GSGSPHSKAQSLQ | 1959 | GSCSPHRKAQNQQ | 2069 | GHDSPHKIGQNQL | 2179 |
| GGGSPHSKALNQQ | 1850 | GSGSPHSKSQSQL | 1960 | GSGSPHFLRQNQQ | 2070 | GHDSPHKSGQIIV | 2180 |
| GSGSPHSKALHQH | 1851 | GSASPHSKAHSQQ | 1961 | GSGSPHSLRFNQQ | 2071 | GYDSPHKSGQKQS | 2181 |
| GTGSPHSKAQNHQ | 1852 | GSGSPHSKAQMPS | 1962 | GSGSPHSKWLLQQ | 2072 | GNGSPHSKAQNQE | 2182 |
| GSGSPHSKAQHRI | 1853 | GSGSPHSKAQGSL | 1963 | GSGSPHSKRRLQQ | 2073 | GDDSPHKSVQNQQ | 2183 |
| GSGSPHSKAQYIH | 1854 | GSGSPHSKSQNQQ | 1964 | GSGSPHSKAQRKL | 2074 | GHDSPHKSVQSHQ | 2184 |
| GGGSPHSKAHNQQ | 1855 | GNGSPHSKSQNQQ | 1965 | GSGSPHSKALRRQ | 2075 | GHDSPHKSGQFVV | 2185 |
| GSGSPHSKAQKFE | 1856 | GSGSPHSKAQVPA | 1966 | GSGSPHSKAQRLR | 2076 | GHDSPHKSRQNLQ | 2186 |
| ESGSPHSKAQNHQ | 1857 | GNGSPHSKAQNLQ | 1967 | GSGSPHSKAQRRL | 2077 | GHNSPHKSGQNQE | 2187 |
| GSGSPHSKAQFPS | 1858 | GSGSPHSKAQDKQ | 1968 | GSGSPHSKARRQQ | 2078 | GHDSPHKSGQSQP | 2188 |
| PSGSPHSKAQNQQ | 1859 | GSGSPHSKAHYQQ | 1969 | GSGSPHSKARRLQ | 2079 | GHESPHKSGQNEQ | 2189 |
| GNGSPHSKAQNPL | 1860 | GSGSPHSKAQVPS | 1970 | GSGSPHSKSRRQQ | 2080 | GHDSPHKSGQNQL | 2190 |
| GGGSPHSKAQSQQ | 1861 | GGGSPHSKAQNHQ | 1971 | GLLSPHWKAQNQQ | 2081 | GHDSPHKSAQNLL | 2191 |
| GSGSPHSKAQAIK | 1862 | GSGSPHSKARGEQ | 1972 | GSGSPHSKARLRQ | 2082 | ASGSPHSKAINQQ | 2192 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GSGSPHSKGQNRQ | 1863 | GGGSPHSKAQYQH | 1973 | GSGSPHSKASKRQ | 2083 | GNGSPHKRGQNQQ | 2193 |
| GSGSPHSKAQSQQ | 1864 | GSGSPHSKAPGQQ | 1974 | GSGSPHVRRQNQQ | 2084 | GHDSPHSGQSLQ | 2194 |
| GSVSPHGKAQNQL | 1865 | KNGSPHSKAQNQQ | 1975 | GSGSPHSKAQLYR | 2085 | GHDSPHSAQNHQ | 2195 |
| ASGSPHSKAQNQL | 1866 | GSGSPHSKRLEQQ | 1976 | GSGSPHSKAQLTV | 2086 | GHDSPHSGRNRQ | 2196 |
| RSGSPHSKAQNQQ | 1867 | GSGSPHSKAQNQS | 1977 | GHDSPHKRGQHRQ | 2087 | GHDSPHYGQNEQ | 2197 |
| GSGSPHSKAQYQH | 1868 | GSGSPHSKAQKVI | 1978 | GHDSPHKSGQKQQ | 2088 | GNGSPHSKAPNLQ | 2198 |
| GSGSPHTKAQNPQ | 1869 | GSGSPHSKAQNND | 1979 | GHDSPHKSGLTQQ | 2089 | GHDSPHSQQNQQ | 2199 |
| GSGSPHSKGQNPP | 1870 | GSGSPHSKAQSVH | 1980 | GDDSPHKSGRNQQ | 2090 | GHDSPHSVQSKQ | 2200 |
| GSGSPHSKAQHQL | 1871 | GSGSPHSKAQPLG | 1981 | GHDSPHKSGLNQQ | 2091 | GNDSPHIGHNQQ | 2201 |
| GSGSPHSKAQSPP | 1872 | KEGSPHSKAQNQQ | 1982 | GHESPHKSAQNHQ | 2092 | GGGSPHSKAQDQQ | 2202 |
| GSGSPHSKAQAKL | 1873 | GSGSPHSKAHNQE | 1983 | GHDSPHKSAQNQW | 2093 | GQDSPHKSGQNPL | 2203 |
| GSGSPHSKTKSQQ | 1874 | GSGSPHSKAQIQQ | 1984 | GHDSPHKSGQNTH | 2094 | ASGSPHSKAQNHQ | 2204 |
| GSGSPHSKAQDRP | 1875 | GSGSPHSKAQVRN | 1985 | GHDSPHKSGRRRQ | 2095 | GHDSPHSGRDQK | 2205 |
| GIGSPHSKAQNLG | 1876 | GSGSPHSKAPSNQ | 1986 | GHDSPHKSAQNQQ | 2096 | GHDSPHSVHNQQ | 2206 |
| GSGSPHSKAQAFH | 1877 | GSGSPHSKAQVGH | 1987 | GHDSPHKSGQYQQ | 2097 | GHDSPHSGQWKR | 2207 |
| GSGSPHSKAQKQQ | 1878 | GSGSPHSKAQRDI | 1988 | GNYSPHKIGQNQQ | 2098 | GSGSPHSKAENRQ | 2208 |
| GSGSPHSKAQNAQ | 1879 | GSGSPHSKAQMPN | 1989 | GHDSPHKSRQNDQ | 2099 | GHDSPHSGQSQQ | 2209 |
| WSGSPHSKAQNQQ | 1880 | AIGSPHSKAQNQQ | 1990 | GHDSPHKSGQIRQ | 2100 | GHDSPHSRQAQQ | 2210 |
| GSGSPHSKAHNQL | 1881 | GSGSPHSKARGLQ | 1991 | GHDSPHKIGQNQH | 2101 | GHDSPHSVQNHQ | 2211 |
| GNGSPHSKAQNHQ | 1882 | GSGSPHSKLQKQQ | 1992 | GYDSPHKSGQKQQ | 2102 | GHDSPHSKQNQQ | 2212 |
| GGGSPHSKAQNLQ | 1883 | GSGSPHSKAPSLQ | 1993 | GHDSPHKSGQSVQ | 2103 | GHDSPHSAQNQL | 2213 |
| GSGSPHSKAQKLN | 1884 | GSGSPHSKAQRDQ | 1994 | GHESPHKSGRSQQ | 2104 | GHDSPHSGQTQP | 2214 |
| GGGSPHSKSQNQH | 1885 | GSGSPHSKNRDQQ | 1995 | GHDSPHKSGQNKL | 2105 | GHDSPHKLWINQQ | 2215 |
| GSGSPHSKSQNVQ | 1886 | GSGSPHSKAQAKG | 1996 | GHDSPHKTGQNQQ | 2106 | GPDSPHKSGQNQQ | 2216 |
| GSGSPHSKAQAQQ | 1887 | GSGSPHSKAQSAH | 1997 | GRGSPHKRGQNQQ | 2107 | GHDSPHSVQKQL | 2217 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| DSGSPHSKAQNQQ | 1888 | GNGSPHSKSQNQH | 1998 | GSGSPHTKAQNPP | 2108 | GHPSPHWKGQNQQ | 2218 |
| ASGSPHSKAPNQQ | 1889 | GSGSPHSKSQNHQ | 1999 | GQDSPHKSGQHQQ | 2109 | GHDSPHKSGRNQL | 2219 |
| GSGSPHSKAQTPP | 1890 | RSGSPHSKAQDQQ | 2000 | GHDSPHKSGQIQH | 2110 | GSGSPHSKVQDQQ | 2220 |
| IDGSPHSKAQNQQ | 1891 | GSGSPHSKAQSTM | 2001 | GHDSPHKSGPRQQ | 2111 | GHDSPHKMGRNQQ | 2221 |
| GSGSPHNKAQNHQ | 1892 | GSGSPHSKAQREM | 2002 | GHDSPHKSGHTQQ | 2112 | GHDSPHKSGISIQ | 2222 |
| GSGSPHSKAQPPA | 1893 | GGGSPHSKSQNRQ | 2003 | GHDSPHKSGQRQH | 2113 | GHDSPHKSVQNLQ | 2223 |
| GSGSPHSKAQERP | 1894 | GSGSPHSKAQYRA | 2004 | GSGSPHTKAQNQQ | 2114 | GHDSPHKMAHNQQ | 2224 |
| GSGSPHSKAQDLQ | 1895 | GGGSPHSKAQRQQ | 2005 | GHDSPHKSAQSQQ | 2115 | GHDSPHKHGQNQQ | 2225 |
| GGGSPHSKAQNPP | 1896 | GSGSPHSKNQWQQ | 2006 | GHESPHKSGQNQQ | 2116 | GHDSPHKSVQSQQ | 2226 |
| GSGSPHSKAQAMH | 1897 | GSGSPHSKAQRMN | 2007 | GHDSPHKSLQNQQ | 2117 | GHDSPHKSGQTVC | 2227 |
| GSGSPHSKALNQQ | 1898 | GSGSPHAKAQNHQ | 2008 | GHGSPHSKAQNPQ | 2118 | GQDSPHKSGQYQQ | 2228 |
| GSGSPHSKAQHPS | 1899 | GSGSPHSKAGDSQ | 2009 | GHDSPHKSGRNQE | 2119 | GHDSPHKSGQQIM | 2229 |
| GLGSPHSKSQNQQ | 1900 | GSGSPHSKLKSQQ | 2010 | GHDSPHKSGQTQL | 2120 | GHDSPHKSRQNEQ | 2230 |
| GTGSPHSKAQNQQ | 1901 | GSGSPHSKAQKIS | 2011 | GHDSPHKSEKNQQ | 2121 | GHDSPHKSGLNHQ | 2231 |
| GSGSPHSKAPGLQ | 1902 | GSGSPHSKAPSMQ | 2012 | GRDSPHKSGQDQQ | 2122 | GYDSPHKSGQNQQ | 2232 |
| GSGSPHSKAQGIR | 1903 | GSGSPHSKASPRQ | 2013 | GHDSPHKTGHNQQ | 2123 | GHDSPHKSGQNLQ | 2233 |
| GSGSPHSKAQAPA | 1904 | GSGSPHSKRMEQQ | 2014 | GYDSPHKSGQTQQ | 2124 | GHDSPHKSRQDQQ | 2234 |
| GSGSPHSKSQSQQ | 1905 | GSGSPHSKAQYQN | 2015 | GHESPHKSGQTQQ | 2125 | GDDSPHKSGQKQL | 2235 |
| GSGSPHSKAQIPP | 1906 | GSGSPHARMQNQQ | 2016 | GHDSPHKSGQSKQ | 2126 | GSGSPHSKAQNQA | 2236 |
| GSGSPHSKAQTQL | 1907 | GSGSPHVKSQNQQ | 2017 | GHDSPHKTGQNQP | 2127 | GDDSPHKSGHNQQ | 2237 |
| GSGSPHSKAQAPS | 1908 | GQDSPHKSGQNQQ | 2018 | GHDSPHKSGQSPQ | 2128 | GHDSPHKSGQMIH | 2238 |
| GHDSPHKSGRNHQ | 2239 | GHDSPHKSVQNRQ | 2240 | GHDSPHKSGQKMN | 2241 | TINGHDSPHKSRLNQP | 2728 |
| TINGSGSPHSKAQNQQ | 2242 | TDRGSGSPHSKAQNQQ | 2404 | TINGSGSPHSKAQSTM | 2566 | TVDGHDSPHKSGQKQQ | 2729 |
| TINGHDSPHKSGQNQQ | 2243 | TINGSGSPHSKAQIPP | 2405 | TVNASGSPHSKAQNQL | 2567 | TINGQDSPHKSGQNQD | 2730 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| TIIGSGSPHSKAQNRH | 2244 | TVKGSGSPHSKAQDQQ | 2406 | TINGSGSPHSKAQREM | 2568 | TIEGHDSPHKSGRNQQ | 2731 |
| TFPGSGSPHSKVQNQQ | 2245 | NADGSGSPHSKAQNQQ | 2407 | TVHGSGSPHSKAQSQQ | 2569 | TTNGHDSPHKSGQNLL | 2732 |
| TEKMSGSPHSKAQNQQ | 2246 | TDKVSGSPHSKAQNQQ | 2408 | TINGGGSPHSKSQNRQ | 2570 | TINGHDSPHKSGQLVI | 2733 |
| EINGRGSPHSKAQNQQ | 2247 | TITGSGSPHSKAQTQL | 2409 | TINGSGSPHSKAQYRA | 2571 | TVNGHDSPHKSRQSQQ | 2734 |
| TVNRNGSPHSKAQNQQ | 2248 | TINGSGSPHSKAQAPS | 2410 | TINGGGSPHSKAQRQQ | 2572 | TINGHDSPHKSGRTQE | 2735 |
| TVNGSGSPHSKARDQQ | 2249 | NCVGSGSPHSKAQNQQ | 2411 | TEPMSGSPHSKAQNQQ | 2573 | TINGHDSPHKSVQTHQ | 2736 |
| TENGSGSPHSKAPNLQ | 2250 | TIRDAGSPHSKAQNQQ | 2412 | TINGSGSPHSKNQWQQ | 2574 | TSNGHDSPHKSGQNQP | 2737 |
| TEKTSGSPHSKAQNQQ | 2251 | TVKDSGSPHSKAQNQQ | 2413 | ETAGSGSPHSKAQNQQ | 2575 | VINGHDSPHKSGQTQQ | 2738 |
| TINGSGSPHSKAHVRQ | 2252 | NALGSGSPHSKAQNQQ | 2414 | TINGSGSPHSKAQRMN | 2576 | TINGPDSPHKIGQNQQ | 2739 |
| TVNGSGSPHSKAPNQH | 2253 | VINGSGSPHSKGQNQQ | 2415 | NNLGSGSPHSKAQNQQ | 2577 | AVNGHDSPHKSVQNQQ | 2740 |
| TEKISGSPHSKAQNQQ | 2254 | TVNGGGSPHSKAQNQQ | 2416 | TINGSGSPHAKAQNHQ | 2578 | TINGHDSPHKSRQDQH | 2741 |
| TINGPGSPHSKAHNQQ | 2255 | TIQDGGSPHSKAQNQQ | 2417 | TIIKNGSPHSKAQNQQ | 2579 | AINGPDSPHKSGQKQQ | 2742 |
| TVNGSGSPHSKTQSQQ | 2256 | TISGGGSPHSKAQNQQ | 2418 | TINGSGSPHSKAGDSQ | 2580 | TINGHDSPHKSRQSQH | 2743 |
| SINESGSPHSKAQNQQ | 2257 | TSNASGSPHSKAHNQQ | 2419 | TINGSGSPHSKLKSQQ | 2581 | TIYGHDSPHKSVQNQL | 2744 |
| TERTSGSPHSKAQNQQ | 2258 | TINGSGSPHSKAQNTY | 2420 | TINGSGSPHSKAQKIS | 2582 | TVNGHDSPHKSGQNLL | 2745 |
| TINGSGSPHSKAQPAK | 2259 | TINGSGSPHSKSQNQH | 2421 | TEYNSGSPHSKAQNQQ | 2583 | TENKSGSPHSKAQNQQ | 2746 |
| TEKSSGSPHSKAQNQQ | 2260 | TINGGGSPHSKAQDKQ | 2422 | TINGSGSPHSKAPSMQ | 2584 | TTNGQDSPHKSGQNQQ | 2747 |
| TSYGNGSPHSKAQNQQ | 2261 | TEFVSGSPHSKAQNQQ | 2423 | AINGSGSPHSKAQNQQ | 2585 | TDKGSGSPHSKAQNQQ | 2748 |
| TEKGSGSPHSKAQNQQ | 2262 | TVNGSGSPHSKAQNHL | 2424 | TINGSGSPHSKASPRQ | 2586 | TIDGHDSPHKSGRNQQ | 2749 |
| TINGSGSPHSKSQTQQ | 2263 | TREISGSPHSKAQNQQ | 2425 | TINGSGSPHSKRMEQQ | 2587 | TINGYDSPHKSGQYQH | 2750 |
| TERISGSPHSKAQNQQ | 2264 | TINGSGSPHSKAQIGM | 2426 | TINGSGSPHSKAQYQN | 2588 | TDNGHDSPHKSRQNQQ | 2751 |
| TERASGSPHSKAQNQQ | 2265 | TIDGSGSPHSKALNKQ | 2427 | TINGSGSPHSKAQYYV | 2589 | TINGHDSPHKSWVRQQ | 2752 |
| ELHGSGSPHSKAQNQQ | 2266 | TIIGGGSPHSKAQNPQ | 2428 | TINGSGSPHSKLRRQQ | 2590 | TINGHESPHKSGQNQH | 2753 |
| AINGSGSPHSKAQNLA | 2267 | QGEGSGSPHSKAQNQQ | 2429 | TINGSGSPHSKAGCGQ | 2591 | TVNGHDSPHKIGHNQQ | 2754 |
| TVNGSGSPHSKSQNQL | 2268 | TINGTGSPHSKAPNQL | 2430 | SMNGSGSPHSRAQNQQ | 2592 | TCNGHDSPHKSGRNQQ | 2755 |

TABLE 1-continued

Exemplary Peptide Sequences

| Peptide Sequence | SEQ ID NO: | Peptide Sequence | SEQ ID NO: | Peptide Sequence | SEQ ID NO: |
|---|---|---|---|---|---|
| TERNSGSPHSKAQNQQ | 2269 | TVNGSGSPHSKAQLQQ | 2431 | TINGSGSPHSKRLRQQ | 2593 | TINGNGSPHSKAQNHQ | 2756 |
| SVNGNGSPHSKAQNQQ | 2270 | TFNGGGSPHSKAQYQQ | 2432 | TINGSGSPHSLRRNQQ | 2594 | NVVGHDSPHKSGQNQQ | 2757 |
| TFNGSGSPHSKAQGQQ | 2271 | SINGSGSPHSKTQSQQ | 2433 | TINGSGSPHSRGRNQQ | 2595 | TINGHDSPHKSNAWQQ | 2758 |
| TERVSGSPHSKAQNQQ | 2272 | TVNGGGSPHSKAQHQQ | 2434 | TINGSGSPHSSRRNQQ | 2596 | TDAGHDSPHKSGQNQQ | 2759 |
| TINGSGSPHSKALNRQ | 2273 | SEKGSGSPHSKAQNQQ | 2435 | TINGSGSPHSKAFRLQ | 2597 | TEVGHDSPHKSGQNQQ | 2760 |
| TERLSGSPHSKAQNQQ | 2274 | NVNGSGSPHSKAQNQQ | 2436 | TINGSCSPHRKAQNQQ | 2598 | SELGHDSPHKSGQNQQ | 2761 |
| TDNGSGSPHSKAHNQQ | 2275 | GGEGSGSPHSKAQNQQ | 2437 | TINGSGSPHFLRQNQQ | 2599 | TINGHDSPHKSGQSVP | 2762 |
| TFHGSGSPHSKTQNQQ | 2276 | TINGSGSPHSKAQRMS | 2438 | TINGSGSPHSLRFNQQ | 2600 | TINGHESPHKSGQNIQ | 2763 |
| TINGGGSPHSKAQTQQ | 2277 | TINGSGSPHSKAQGIL | 2439 | TINGSGSPHSKWLLQQ | 2601 | TINGHDSPHKSVQNHL | 2764 |
| TSNGSGSPHSKAQNPP | 2278 | EFVGSGSPHSKAQNQQ | 2440 | TINGSGSPHSKRRLQQ | 2602 | TINGHDSPHKIGLDQQ | 2765 |
| TINGSGSPHSKAQNLQ | 2279 | TIIGSGSPHSKAQDRQ | 2441 | TINGSGSPHSKAQRKL | 2603 | TSNASGSPHSKAQHQQ | 2766 |
| TVHGNGSPHSKAQNQQ | 2280 | SDKGSGSPHSKAQNQQ | 2442 | TINGSGSPHSKALRRQ | 2604 | TINGHDSPHKRGPDQQ | 2767 |
| TINGGSPHSKAQNQQ | 2281 | TEQVSGSPHSKAQNQQ | 2443 | TINGSGSPHSKAQRLR | 2605 | TINGMGSPHSKTQNQQ | 2768 |
| TENMSGSPHSKAQNQQ | 2282 | TEHVSGSPHSKAQNQQ | 2444 | YLSGSGSPHSKAQNQQ | 2606 | TIKGHDSPHKSGESQQ | 2769 |
| TENVSGSPHSKAQNQQ | 2283 | TINGSGSPHSKARDWQ | 2445 | TINGSGSPHSKAQRRL | 2607 | TINGHDSPHKHGQNHQ | 2770 |
| TSSGSGSPHSKAQYQQ | 2284 | TENASGSPHSKAQNQQ | 2446 | TINGSGSPHSKARRQQ | 2608 | TVNGTGSPHSKAQNQL | 2771 |
| TIDGGGSPHSKAQNKQ | 2285 | EVQGSGSPHSKAQNQQ | 2447 | TINGSGSPHSKARRLQ | 2609 | TIIGHDSPHKSGQYQH | 2772 |
| TEKVSGSPHSKAQNQQ | 2286 | TINGSGSPHSKAQNTH | 2448 | TINGSGSPHSKSRRQQ | 2610 | TSNGHDSPHKSVQNKQ | 2773 |
| AINGSGSPHSKAQDQE | 2287 | TINGSGSPHSKAPNLQ | 2449 | TINGLLSPHWKAQNQQ | 2611 | IVNGQVSPHKSGQNQQ | 2774 |
| TCNKSGSPHSKAQNQQ | 2288 | TINGSGSPHSKAQERS | 2450 | TINGSGSPHSKARLRQ | 2612 | TVNGHDSPHKSGQRQL | 2775 |
| TINGGGSPHSKAQNQL | 2289 | TSNGSGSPHSKAQNYQ | 2451 | TINGSGSPHSKASKRQ | 2613 | TVNGHDSPHKIGQNQL | 2776 |
| NINGGGSPHSKAQNQQ | 2290 | TEYISGSPHSKAQNQQ | 2452 | TINGSGSPHVRRQNQQ | 2614 | TINGHDSPHKSGQIIV | 2777 |
| TEHLSGSPHSKAQNQQ | 2291 | TINGSGSPHSKAQRTC | 2453 | TINGSGSPHSKAQLYR | 2615 | IGNGHESPHKSGQNQQ | 2778 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| AEMGSGSPHSKAQNQQ | 2292 | TINGSGSPHSKQIGH | 2454 | GLSGSGSPHSKAQNQQ | 2616 | EVMGHDSPHKSGQNQQ | 2779 |
| ATNGSGSPHSKAQNHQ | 2293 | NCWGSGSPHSKAQNQQ | 2455 | TINGSGSPHSKAQLTV | 2617 | TINGYDSPHKSGQKQS | 2780 |
| AIKGSGSPHSKAQDQQ | 2294 | TINGSGSPHSKAQGAI | 2456 | TINGHDSPHKRGQHRQ | 2618 | TIHGNGSPHSKAQNQE | 2781 |
| TINGGGSPHSKSQNQL | 2295 | TDVNSGSPHSKAQNQQ | 2457 | MPEGHDSPHKSGQNQQ | 2619 | YQVGHDSPHKSGQNQQ | 2782 |
| TVNGNGSPHSKAQNKQ | 2296 | SDIGSGSPHSKAQNQQ | 2458 | MEGGHDSPHKSGQNQQ | 2620 | TIKGDDSPHKSVQNQQ | 2783 |
| TINGSGSPHSKGHWQQ | 2297 | TINGSGSPHSKAQVPP | 2459 | MEYGHDSPHKSGQNQQ | 2621 | TINGHDSPHKSVQSHQ | 2784 |
| TDKTSGSPHSKAQNQQ | 2298 | TINGSGSPHSKAQVQQ | 2460 | AEWGHDSPHKSGQNQQ | 2622 | TINGHDSPHKSGQFVV | 2785 |
| TFKGSGSPHSKAPNQQ | 2299 | TINGSGSPHSKALMRQ | 2461 | CEWGHDSPHKSGQNQQ | 2623 | TVNGHDSPHKSRQNLQ | 2786 |
| TVNGSGSPHSKAQNQL | 2300 | TINGSGSPHSKAQYSV | 2462 | ANNGQDSPHKSGQNQQ | 2624 | ATNGHNSPHKSGQNQE | 2787 |
| TINGSGSPHSKRPEQQ | 2301 | NSIGSGSPHSKAQNQQ | 2463 | IPEGHDSPHKSGQNQQ | 2625 | AINGHDSPHKSAQNQQ | 2788 |
| TINGSGSPHSKAQRTM | 2302 | TINGSGSPHSKVPNLQ | 2464 | ADMGHDSPHKSGQNQQ | 2626 | TEHGHDSPHKSGQNQQ | 2789 |
| TEKASGSPHSKAQNQQ | 2303 | AINGSGSPHSKAQSQQ | 2465 | IEYGHDSPHKSGQNQQ | 2627 | TIYGHDSPHKSGQSQP | 2790 |
| SDQGSGSPHSKAQNQQ | 2304 | TINGSGSPHSKAQAIT | 2466 | ADYGHDSPHKSGQNQQ | 2628 | TISGHESPHKSGQNEQ | 2791 |
| TEITSGSPHSKAQNQQ | 2305 | TINGSGSPHSKAQKTL | 2467 | IETGHDSPHKSGQNQQ | 2629 | AIIGHDSPHKSAQNQQ | 2792 |
| TDKSSGSPHSKAQNQQ | 2306 | TVNGSGSPHSKAQNQW | 2468 | MEWGHDSPHKSGQNQQ | 2630 | AIDGHDSPHKSGQNQL | 2793 |
| TIDGSGSPHSKAQNQQ | 2307 | TINGSGSPHSKAQLHH | 2469 | CEYGHDSPHKSGQNQQ | 2631 | TIMGHDSPHKSVQNQQ | 2794 |
| TVNGNGSPHSKAQNQH | 2308 | TEQTSGSPHSKAQNQQ | 2470 | RINGHDSPHKSGQKQQ | 2632 | EVGGHDSPHKSGQNQQ | 2795 |
| NTNGSGSPHSKAQNQQ | 2309 | TINGSGSPHSKAQNII | 2471 | MEIGHDSPHKSGQNQQ | 2633 | TINGHDSPHKSAQNLL | 2796 |
| TETHSGSPHSKAQNQQ | 2310 | NSLGSGSPHSKAQNQQ | 2472 | LEYGHDSPHKSGQNQQ | 2634 | TINASGSPHSKAINQQ | 2797 |
| TINGGGSPHSKALNQQ | 2311 | TIPMEGSPHSKAQNQQ | 2473 | ADWGHDSPHKSGQNQQ | 2635 | AINGNGSPHSKRGQNQQ | 2798 |
| TINGSGSPHSKALHQH | 2312 | TINGSGSPHSKAQGHH | 2474 | IEIGHDSPHKSGQNQQ | 2636 | SEMGHDSPHKSGQNQQ | 2799 |
| TINGTGSPHSKAQNHQ | 2313 | TDRTSGSPHSKAQNQQ | 2475 | DIMGHDSPHKSGQNQQ | 2637 | AQQGHDSPHKSGQNQQ | 2800 |
| TINGSGSPHSKAQHRI | 2314 | TINGSGSPHSKAQSKV | 2476 | FEQGHDSPHKSGQNQQ | 2638 | AINGHDSPHKSGQSLQ | 2801 |
| TINGSGSPHSKAQYIH | 2315 | EVVGSGSPHSKAQNQQ | 2477 | MEFGHDSPHKSGQNQQ | 2639 | TINGSGSPHSKAPNQQ | 2802 |
| TENISGSPHSKAQNQQ | 2316 | TINGSGSPHSKAQLPS | 2478 | CDQGHDSPHKSGQNQQ | 2640 | CGEGHDSPHKSGQNQQ | 2803 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| TIIGGGSPHSKAHNQQ | 2317 | TINGSGSPHSKAIGKQ | 2479 | LPEGHDSPHKSGQNQQ | 2641 | TVNGHDSPHKSAQNHQ | 2804 |
| TINGSGSPHSKAQKFE | 2318 | TEPTSGSPHSKAQNQQ | 2480 | IENGHDSPHKSGQNQQ | 2642 | TVNGHDSPHKSGQTQL | 2805 |
| TSNESGSPHSKAQNHQ | 2319 | TVNGGGSPHSKSQNQQ | 2481 | MESGHDSPHKSGQNQQ | 2643 | TNNGHDSPHKSGRNRQ | 2806 |
| TINGSGSPHSKAQFPS | 2320 | TINGSGSPHSKAQAIH | 2482 | AEIGHDSPHKSGQNQQ | 2644 | TINGHDSPHKYGQNEQ | 2807 |
| TERPSGSPHSKAQNQQ | 2321 | TINGSGSPHSKAQHGL | 2483 | VEYGHDSPHKSGQNQQ | 2645 | TINGNGSPHSKAPNLQ | 2808 |
| TINGNGSPHSKAQNPL | 2322 | SELGSGSPHSKAQNQQ | 2484 | IINGHDSPHKSGLTQQ | 2646 | SINGHDSPHKSQQNQQ | 2809 |
| SIKGNGSPHSKAQNQQ | 2323 | TINGSGSPHSKAQFMC | 2485 | TSNGDDSPHKSGRNQQ | 2647 | TIGGHDSPHKSGQNQQ | 2810 |
| TERMSGSPHSKAQNQQ | 2324 | TINVSGSPHSKAQGQQ | 2486 | IEVGHDSPHKSGQNQQ | 2648 | TINGHDSPHKSVQSKQ | 2811 |
| TERSSGSPHSKAQNQQ | 2325 | TINGGGSPHSKAQNQM | 2487 | MEMGHDSPHKSGQNQQ | 2649 | ELVGHDSPHKSGQNQQ | 2812 |
| TELHSGSPHSKAQNQQ | 2326 | TVNGSGSPHSKAQHLQ | 2488 | AEVGHDSPHKSGQNQQ | 2650 | ELMGHDSPHKSGQNQQ | 2813 |
| TELTSGSPHSKAQNQQ | 2327 | TIRENGSPHSKAQNQQ | 2489 | MDAGHDSPHKSGQNQQ | 2651 | TINGNDSPHKIGHNQQ | 2814 |
| TINGSGSPHSKAHNQQ | 2328 | TINGSGSPHSKTQNHQ | 2490 | VEWGHDSPHKSGQNQQ | 2652 | TIKGGGSPHSKAQDQQ | 2815 |
| TINGGGSPHSKAQSQQ | 2329 | TINGSGSPHSKAQPAR | 2491 | AEQGHDSPHKSGQNQQ | 2653 | TVNGHDSPHKSGQTQQ | 2816 |
| TINGSGSPHSKAQAIK | 2330 | TVNGSGSPHSKAQSLQ | 2492 | LEWGHDSPHKSGQNQQ | 2654 | TINGQDSPHKSGQNPL | 2817 |
| TENTSGSPHSKAQNQQ | 2331 | TINGSGSPHSKSQSQL | 2493 | MELGHDSPHKSGQNQQ | 2655 | TVNASGSPHSKAQNHQ | 2818 |
| TIDGSGSPHSKGQNRQ | 2332 | TINGSASPHSKAHSQQ | 2494 | METGHDSPHKSGQNQQ | 2656 | TINGHDSPHKSGRDQK | 2819 |
| NINGSGSPHSKAQSQQ | 2333 | TWQNSGSPHSKAQNQQ | 2495 | MEAGHDSPHKSGQNQQ | 2657 | TINGHDSPHKSVHNQQ | 2820 |
| TINGSVSPHGKAQNQL | 2334 | TINGSGSPHSKAQDRQ | 2496 | IESGHDSPHKSGQNQQ | 2658 | TINGHDSPHKSGQWKR | 2821 |
| TSNASGSPHSKAQNQL | 2335 | TINGSGSPHSKAQMPS | 2497 | MEVGHDSPHKSGQNQQ | 2659 | TIDGSGSPHSKAENRQ | 2822 |
| TEARSGSPHSKAQNQQ | 2336 | TNNGGGSPHSKAQNLQ | 2498 | CEIGHDSPHKSGQNQQ | 2660 | NEIGHDSPHKSGQNQQ | 2823 |
| TEKNSGSPHSKAQNQQ | 2337 | TINGSGSPHSKAQGSL | 2499 | ATNGHDSPHKSGLNQQ | 2661 | AINGHDSPHKSGQSQQ | 2824 |
| TANGSGSPHSKAQYQQ | 2338 | TEVTSGSPHSKAQNQQ | 2500 | MDGGHDSPHKSGQNQQ | 2662 | IINGHDSPHKSRQAQQ | 2825 |
| TVNGSGSPHSKAQYQH | 2339 | SINGGGSPHSKAQYQQ | 2501 | QEVGHDSPHKSGQNQQ | 2663 | TPNGHDSPHKSGQNQQ | 2826 |
| TINGSGSPHTKAQNPQ | 2340 | TVIGSGSPHSKSQNQQ | 2502 | ADQGHDSPHKSGQNQQ | 2664 | ITNGHDSPHKSGQTQQ | 2827 |
| TINGSGSPHSKGQNPP | 2341 | AVNVSGSPHSKAQNQQ | 2503 | TINGHESPHKSAQNHQ | 2665 | TINGHDSPHKSVQNHQ | 2828 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| TIIGSGSPHSKAQHQL | 2342 | TVNGNGSPHSKSQNQQ | 2504 | TINGHDSPHKSAQNQW | 2666 | TINGHDSPHKSKQNQQ | 2829 |
| TINGSGSPHSKAQSPP | 2343 | TDRNSGSPHSKAQNQQ | 2505 | NMNGHDSPHKSGQNTH | 2667 | TINGHDSPHKSAQNQL | 2830 |
| TIYGSGSPHSKAQNQQ | 2344 | TINGSGSPHSKAQVPA | 2506 | IEMGHDSPHKSGQNQQ | 2668 | TVNGHDSPHKSGQTQP | 2831 |
| TINGSGSPHSKAQAKL | 2345 | GVLGSGSPHSKAQNQQ | 2507 | TINGHDSPHKSGRRRQ | 2669 | TDQGHDSPHKSGQNQQ | 2832 |
| TDKNSGSPHSKAQNQQ | 2346 | TLNGNGSPHSKAQNLQ | 2508 | ISNGHDSPHSAQNQQ | 2670 | TINGHDSPHKLWINQQ | 2833 |
| TINGSGSPHSKTKSQQ | 2347 | AINGSGSPHSKAQDKQ | 2509 | TGNGHDSPHKSGQYQQ | 2671 | GINGPDSPHKSGQNQQ | 2834 |
| TINGSGSPHSKAQDRP | 2348 | TSNGSGSPHSKAHYQQ | 2510 | TINGNYSPHKIGQNQQ | 2672 | SEIGHDSPHKSGQNQQ | 2835 |
| TINGIGSPHSKAQNLG | 2349 | TINGSGSPHSKAQVPS | 2511 | TINGHDSPHKSRQNDQ | 2673 | TINGHDSPHKSVQKQL | 2836 |
| TINGSGSPHSKAQSQQ | 2350 | TELRSGSPHSKAQNQQ | 2512 | QQQGHDSPHKSGQNQQ | 2674 | TINGHPSPHWKGQNQQ | 2837 |
| TENLSGSPHSKAQNQQ | 2351 | NINGSGSPHSKAQNHQ | 2513 | HDWGHDSPHKSGQNQQ | 2675 | TVNGHDSPHKSGRNQL | 2838 |
| TINGSGSPHSKAQAFH | 2352 | TVNGGGSPHSKAQNHQ | 2514 | IEGGHDSPHKSGQNQQ | 2676 | TIKGSGSPHSKVQDQQ | 2839 |
| TINGSGSPHSKAQKQQ | 2353 | TINGSGSPHSKARGEQ | 2515 | TFNRSGSPHSKAQNQQ | 2677 | SEKGHDSPHKSGQNQQ | 2840 |
| TFSGSGSPHSKAQNLQ | 2354 | TINGGGSPHSKAQYQH | 2516 | AINGHDSPHKSGQIRQ | 2678 | WSAGHDSPHKSGQNQQ | 2841 |
| AINGSGSPHSKAQNAQ | 2355 | TEDLSGSPHSKAQNQQ | 2517 | TINGHDSPHKIGQNQH | 2679 | ELAGHDSPHKSGQNQQ | 2842 |
| TESWSGSPHSKAQNQQ | 2356 | TINGSGSPHSKAPGQQ | 2518 | AINGYDSPHKSGQKQQ | 2680 | TINGHDSPHKMGRNQQ | 2843 |
| TTNGSGSPHSKAHNQL | 2357 | TIPKNGSPHSKAQNQQ | 2519 | TESGHDSPHKSGQNQQ | 2681 | TINGHDSPHKSGISIQ | 2844 |
| TVNGNGSPHSKAQNHQ | 2358 | TINGSGSPHSKAQSLQ | 2520 | TINGHDSPHKSGQSVQ | 2682 | TSNGHDSPHKSVQNLQ | 2845 |
| TEDKSGSPHSKAQNQQ | 2359 | TINGSGSPHSKRLEQQ | 2521 | TINGHESPHKSGRSQQ | 2683 | QTQGHDSPHKSGQNQQ | 2846 |
| TESASGSPHSKAQNQQ | 2360 | TERGSGSPHSKAQNQQ | 2522 | TINGHDSPHKSGQNKL | 2684 | TINGHDSPHKMAHNQQ | 2847 |
| TNNGSGSPHSKAQNQQ | 2361 | TVNGSGSPHSKAPNQQ | 2523 | TINGHDSPHKTGQNQQ | 2685 | AINGSGSPHSKAQTQQ | 2848 |
| TSNGGGSPHSKAQNLQ | 2362 | TSNGSGSPHSKAQNQS | 2524 | TINGRGSPHKRGQNQQ | 2686 | TINGHDSPHKHGQNQQ | 2849 |
| TDKMSGSPHSKAQNQQ | 2363 | TINGSGSPHSKAQKVI | 2525 | TINGSGSPHTKAQNPP | 2687 | GADGHDSPHKSGQNQQ | 2850 |
| EVHGSGSPHSKAQNQQ | 2364 | TEGISGSPHSKAQNQQ | 2526 | TINGQDSPHKSGQHQQ | 2688 | VGEGHDSPHKSGQNQQ | 2851 |
| TINGSGSPHSKAQKLN | 2365 | TINGSGSPHSKAQNND | 2527 | SINGHDSPHKSGQIQH | 2689 | ANEGHDSPHKSGQNQQ | 2852 |
| TINGGGSPHSKSQNQH | 2366 | TINGSGSPHSKAQSVH | 2528 | AINGHDSPHKSGPRQQ | 2690 | TEAKSGSPHSKAQNQQ | 2853 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| TVNGGGSPHSKAQSQQ | 2367 | TINGSGSPHSKAQPLG | 2529 | TVNGHDSPHKSGHTQQ | 2691 | TINGHDSPHKSVQSQQ | 2854 |
| TTNGSGSPHSKAQYQH | 2368 | TINKEGSPHSKAQNQQ | 2530 | SINGHDSPHKSGRQH | 2692 | TIPGSGSPHSKAQNLQ | 2855 |
| TISGSGSPHSKAQYQH | 2369 | TCNASGSPHSKAQNQQ | 2531 | SLNGSGSPHTKAQNQQ | 2693 | TINGHDSPHKSGQTVC | 2856 |
| TESTSGSPHSKAQNQQ | 2370 | AINGSGSPHSKAHNQE | 2532 | AINGHDSPHKSAQSQQ | 2694 | ELRGHDSPHKSGQNQQ | 2857 |
| TINGSGSPHSKSQNVQ | 2371 | TEGLSGSPHSKAQNQQ | 2533 | SIYGHESPHKSGQNQQ | 2695 | CQIGHDSPHKSGQNQQ | 2858 |
| SINGSGSPHSKAQAQQ | 2372 | TRDASGSPHSKAQNQQ | 2534 | TVNGHDSPHKSLQNQQ | 2696 | GVMGHDSPHKSGQNQQ | 2859 |
| TVNGSGSPHSKAQNLQ | 2373 | TSNGSGSPHSKAQNLQ | 2535 | TINGHGSPHSKAQNPQ | 2697 | ACDGHDSPHKSGQNQQ | 2860 |
| TVRDSGSPHSKAQNQQ | 2374 | TGNGSGSPHSKAQIQQ | 2536 | TSNGYDSPHKSGQKQQ | 2698 | TINGQDSPHKSGQYQQ | 2861 |
| TFNASGSPHSKAPNQQ | 2375 | TVNGGGSPHSKAQNLQ | 2537 | TVNGHDSPHKSGRNQE | 2699 | TINGHDSPHKSGQQIM | 2862 |
| TDRMSGSPHSKAQNQQ | 2376 | TDRSSGSPHSKAQNQQ | 2538 | TTNGHDSPHKSGQTQL | 2700 | TINGHDSPHKSRQNEQ | 2863 |
| TINGSGSPHSKAQTPP | 2377 | TINGSGSPHSKAQVRN | 2539 | AINGHDSPHKSEKNQQ | 2701 | ASNGHDSPHKSGLNHQ | 2864 |
| TIKGSGSPHSKAQNQQ | 2378 | TINGSGSPHSKAPSNQ | 2540 | IINGRDSPHKSGDQQ | 2702 | TVNGHDSPHKSGQSQP | 2865 |
| NHIGSGSPHSKAQNQQ | 2379 | TINGSGSPHSKAQVGH | 2541 | TISGHDSPHKTGHNQQ | 2703 | NELGHDSPHKSGQNQQ | 2866 |
| TINGSGSPHSKAQYQH | 2380 | NAIGSGSPHSKAQNQQ | 2542 | SINGYDSPHKSGQTQQ | 2704 | AAEGHDSPHKSGQNQQ | 2867 |
| TIPIDGSPHSKAQNQQ | 2381 | AENGSGSPHSKAQNQQ | 2543 | TINGHESPHKSGQTQQ | 2705 | GQNGHDSPHKSGQNQQ | 2868 |
| TINGSGSPHSKAQGQQ | 2382 | TINGSGSPHSKAQRDI | 2544 | TINGHDSPHKSGQSKQ | 2706 | NEFGHDSPHKSGQNQQ | 2869 |
| TFNGSGSPHNKAQNHQ | 2383 | TINGSGSPHSKAQMPN | 2545 | AIIGHESPHKSGQNQQ | 2707 | TSIGYDSPHKSGQNQQ | 2870 |
| ESDGSGSPHSKAQNHQ | 2384 | TVNGSGSPHSKSQNQQ | 2546 | TINGHDSPHKTGQNQP | 2708 | TDNGHDSPHKSGQNLQ | 2871 |
| TINGSGSPHSKAQPPA | 2385 | TIPAIGSPHSKAQNQQ | 2547 | AINGHDSPHKSGQSPQ | 2709 | TITGHDSPHKSRQDQQ | 2872 |
| TINGSGSPHSKAQERP | 2386 | TINGSGSPHSKARGLQ | 2548 | TIKGNDSPHKSVQNQQ | 2710 | AEHGHDSPHKSGQNQQ | 2873 |
| TIKGSGSPHSKAQDLQ | 2387 | TELGSGSPHSKAQNQQ | 2549 | TEFGHDSPHKSGQNQQ | 2711 | TINGDDSPHKSGQKQL | 2874 |
| TDLKSGSPHSKAQNQQ | 2388 | AETGSGSPHSKAQNQQ | 2550 | TINGHDSPHSAQNYQ | 2712 | EILGHDSPHKSGQNQQ | 2875 |
| TINGGGSPHSKAQNPP | 2389 | TINGSGSPHSKLQKQQ | 2551 | TFNGSASPHSKALNQQ | 2713 | TIHGSGSPHSKAQNQA | 2876 |
| TINGSGSPHSKAQAMH | 2390 | TINGSGSPHSKAPSLQ | 2552 | TINGHESPHKSAQNRQ | 2714 | AINGDDSPHKSGHNQQ | 2877 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| TVPNSGSPHSKAQNQQ | 2391 | TINGSGSPHSKAQRDQ | 2553 | TTNGHDSPHKSGQNQQ | 2715 | TSNGHNSPHKSGQNQE | 2878 |
| TVIGSGSPHSKALNQQ | 2392 | TDVGSGSPHSKAQNQQ | 2554 | TIKGQDSPHKIGQNQQ | 2716 | TINGHDSPHKSGQMIH | 2879 |
| TINGSGSPHSKAQHPS | 2393 | TINGSGSPHSKNRDQQ | 2555 | TVNGHDSPHKSGQNHL | 2717 | NAIGHDSPHKSGQNQQ | 2880 |
| TINGLGSPHSKSQNQQ | 2394 | SINGSGSPHSKAPNLQ | 2556 | SINGHDSPHKSGQYQH | 2718 | VINGHDSPHKSGRNHQ | 2881 |
| TINGTGSPHSKAQNQQ | 2395 | TINGSGSPHSKAQAKG | 2557 | TINGNDSPHKSVQNHQ | 2719 | TITGHDSPHKSVQNRQ | 2882 |
| TINGSGSPHSKAPGLQ | 2396 | TVNGSGSPHSKAQDKQ | 2558 | TITGHDSPHKSGQNQW | 2720 | TINGHDSPHKSGQKMN | 2883 |
| TINGSGSPHSKAQGIR | 2397 | TINGGGSPHSKAQNPQ | 2559 | TNNGHDSPHKSVQNQH | 2721 | TIHGHDSPHKSGQSQQ | 2884 |
| TESHSGSPHSKAQNQQ | 2398 | TINGSGSPHSKAQSAH | 2560 | TIDGHDSPHKSGQNQH | 2722 | TEIGHDSPHKSGQNQQ | 2885 |
| TINGSGSPHSKAQAPA | 2399 | TINGNGSPHSKSQNQH | 2561 | TVNGHDSPHKSGQTRQ | 2723 | TINGHDSPHKSGQYQH | 2886 |
| TINGSGSPHSKSQSQQ | 2400 | TVPTSGSPHSKAQNQQ | 2562 | TVNGHDSPHKSGQNLH | 2724 | NCLGSGSPHSKAQNQQ | 2403 |
| AEHGSGSPHSKAQNQQ | 2401 | TIDGSGSPHSKSQNHQ | 2563 | AISGHDSPHKSGLNQQ | 2725 | AINRSGSPHSKAQDQQ | 2565 |
| TEDRSGSPHSKAQNQQ | 2402 | TDVKSGSPHSKAQNQQ | 2564 | AINGHDSPHKSAQNQE | 2726 | TITGHDSPHKSGQHLQ | 2727 |
| GSGSPHSKAQNRHT | 2887 | GSGSPHSKAQSQQT | 2936 | GSGSPHSKAQRMST | 2985 | GSGSPHSKAQNNDQ | 3034 |
| GSGSPHSKVQNQQT | 2888 | ASGSPHSKAQNQLT | 2937 | GSGSPHSKAQGILT | 2986 | GSGSPHSKAQSVHT | 3035 |
| MSGSPHSKAQNQQT | 2889 | RSGSPHSKAQNQQT | 2938 | GSGSPHSKAQDRQT | 2987 | GSGSPHSKAQPLGT | 3036 |
| GSGSPHSKARDQQT | 2890 | GSGSPHSKAQYQHT | 2939 | GSGSPHSKAQRDWQT | 2988 | GSGSPHSKAHNQET | 3037 |
| GSGSPHSKAPNLQT | 2891 | GSGSPHTKAQNPQS | 2940 | GSGSPHSKAQNTHD | 2989 | GSGSPHSKAQNLQI | 3038 |
| TSGSPHSKAQNQQT | 2892 | GSGSPHSKGQNPPT | 2941 | GSGSPHSKAPNLQI | 2990 | GSGSPHSKAQIQQT | 3039 |
| GSGSPHSKAHVRQT | 2893 | GSGSPHSKAQHQLT | 2942 | GSGSPHSKAQERST | 2991 | GSGSPHSKAQVRNT | 3040 |
| GSGSPHSKAPNQHT | 2894 | GSGSPHSKAQSPPT | 2943 | GSGSPHSKAQNYQT | 2992 | GSGSPHSKAPSNQT | 3041 |
| ISGSPHSKAQNQQT | 2895 | GSGSPHSKAQAKLT | 2944 | GSGSPHSKAQRTCT | 2993 | GSGSPHSKAQVGHT | 3042 |
| GSGSPHSKTQSQQT | 2896 | GSGSPHSKTKSQQT | 2945 | GSGSPHSKAQIGHT | 2994 | GSGSPHSKAQRDIT | 3043 |
| GSGSPHSKAQNQST | 2897 | GSGSPHSKAQDRPT | 3032 | GSGSPHSKAQGAIT | 2995 | GSGSPHSKAQMPNT | 3044 |
| ESGSPHSKAQNQQI | 2898 | GSGSPHSKAQSQQL | 2947 | GSGSPHSKAQVPPT | 2996 | GSGSPHSKARGLQT | 3045 |
| GSGSPHSKAQPAKT | 2899 | GSGSPHSKAQAFHT | 2948 | GSGSPHSKAQVQQI | 2997 | GSGSPHSKLQKQQT | 3046 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| SSGSPHSKAQNQQT | 2900 | GSGSPHSKAQKQQD | 2949 | GSGSPHSKALMRQT | 2998 | GSGSPHSKAPSLQT | 3047 |
| GSGSPHSKSQTQQN | 2901 | GSGSPHSKAQNAQT | 2950 | GSGSPHSKAQYSVT | 2999 | GSGSPHSKAQRDQT | 3048 |
| ASGSPHSKAQNQQT | 2902 | WSGSPHSKAQNQQT | 2951 | GSGSPHSKVPNLQT | 3000 | GSGSPHSKNRDQQT | 3049 |
| GSGSPHSKAQNLAT | 2903 | GSGSPHSKAHNQLT | 2952 | GSGSPHSKAQSQQI | 3001 | GSGSPHSKAQAKGT | 3050 |
| GSGSPHSKSQNQLT | 2904 | GSGSPHSKAQNQQY | 2953 | GSGSPHSKAQAITT | 3002 | GSGSPHSKAQSAHT | 3051 |
| NSGSPHSKAQNQQT | 2905 | GSGSPHSKAQKLNT | 2954 | GSGSPHSKAQKTLT | 3003 | GSGSPHSKSQNHQT | 3052 |
| GSGSPHSKAQGQQT | 2906 | GSGSPHSKSQNVQT | 2955 | GSGSPHSKAQNQWT | 3004 | RSGSPHSKADQQT | 3053 |
| VSGSPHSKAQNQQT | 2907 | GSGSPHSKAQAQQT | 2956 | GSGSPHSKAQLHHT | 3005 | GSGSPHSKAQSTMT | 3054 |
| GSGSPHSKALNRQS | 2908 | GSGSPHSKAQNLQA | 2957 | GSGSPHSKAQNIII | 3006 | GSGSPHSKAQREMT | 3055 |
| LSGSPHSKAQNQQT | 2909 | DSGSPHSKAQNQQT | 2958 | GSGSPHSKAQGHHT | 3007 | GSGSPHSKAQYRAT | 3056 |
| GSGSPHSKAHNQQT | 2910 | ASGSPHSKAPNQQT | 2959 | GSGSPHSKAQSKVT | 3008 | GSGSPHSKNQWQQT | 3057 |
| GSGSPHSKTQNQQT | 2911 | GSGSPHSKAQTPPT | 2960 | GSGSPHSKAQLPST | 3009 | GSGSPHSKAQRMNT | 3058 |
| GSGSPHSKAQNPPT | 2912 | GSGSPHSKAQYQHA | 2961 | GSGSPHSKAIGKQT | 3010 | GSGSPHAKAQNHQT | 3059 |
| GSGSPHSKAQNLQT | 2913 | GSGSPHSKAQGQQA | 2962 | GSGSPHSKAQAIHT | 3011 | GSGSPHSKAGDSQT | 3060 |
| GSGSPHSKAQYQQT | 2914 | GSGSPHNKAQNHQT | 2963 | GSGSPHSKAQHGLT | 3012 | GSGSPHSKLKSQQT | 3061 |
| GSGSPHSKAQDQET | 2915 | GSGSPHSKAQPPAT | 2964 | GSGSPHSKAQFMCT | 3013 | GSGSPHSKAQKIST | 3062 |
| KSGSPHSKAQNQQT | 2916 | GSGSPHSKAQERPT | 2965 | VSGSPHSKAQGQQT | 3014 | GSGSPHSKAPSMQT | 3063 |
| GSGSPHSKAQNHQT | 2917 | GSGSPHSKAQDLQT | 2966 | GSGSPHSKAQHLQT | 3015 | GSGSPHSKASPRQT | 3064 |
| GSGSPHSKAQDQQT | 2918 | GSGSPHSKAQAMHT | 2967 | GSGSPHSKTQNH?N | 3016 | GSGSPHSKRMEQQT | 3065 |
| GSGSPHSKGHWQQT | 2919 | GSGSPHSKALNQQT | 2968 | GSGSPHSKAQPART | 3017 | GSGSPHSKAQYQNT | 3066 |
| GSGSPHSKAPNQQT | 2920 | GSGSPHSKAQHPST | 2969 | GSGSPHSKAQSLQT | 3018 | RSGSPHSKAQNQQI | 3067 |
| GSGSPHSKAQNQLI | 2921 | GSGSPHSKAPGLQT | 2970 | GSGSPHSKSQSQLT | 3019 | GSGSPHTKAQNPPT | 3068 |
| GSGSPHSKRPEQQT | 2922 | GSGSPHSKAQGIRT | 2971 | GSGSPHSKAQDRQS | 3020 | GSGSPHTKAQNQQT | 3069 |
| GSGSPHSKAQRTMT | 2923 | GSGSPHSKAQAPAT | 2972 | GSGSPHSKAQMPST | 3021 | ASGSPHSKAQHQQT | 3070 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GSGSPHSKAQNQQH | 2924 | GSGSPHSKSQSQQI | 2973 | GSGSPHSKAQGSLT | 3022 | ASGSPHSKAINQQT | 3071 |
| HSGSPHSKAQNQQT | 2925 | GSGSPHSKAQIPPT | 2974 | GSGSPHSKSQNQQT | 3023 | GSGSPHSKAPNQQH | 3072 |
| GSGSPHSKALHQHT | 2926 | GSGSPHSKAQTQLT | 2975 | GSGSPHSKAQVPAT | 3024 | ASGSPHSKAQNHQT | 3073 |
| GSGSPHSKAQHRIT | 2927 | GSGSPHSKAQAPST | 2928 | GSGSPHSKAQDKQT | 3025 | GSGSPHSKAENRQT | 3074 |
| GSGSPHSKAQYIHT | 2928 | GSGSPHSKGNQQT | 2977 | GSGSPHSKAHYQQT | 3026 | GSGSPHSKVQDQQT | 3075 |
| GSGSPHSKAQKFET | 2929 | ASGSPHSKAHNQQT | 2978 | GSGSPHSKAQVPST | 3027 | GSGSPHSKAQTQQA | 3076 |
| ESGSPHSKAQNHQT | 2930 | GSGSPHSKAQNTYA | 2979 | GSGSPHSKARGEQT | 3028 | GSGSPHSKAQNQAT | 3077 |
| GSGSPHSKAQFPST | 2931 | GSGSPHSKSQNQHI | 2980 | GSGSPHSKAPGQQT | 3029 | GSGSPHSKGQNRQT | 2935 |
| PSGSPHSKAQNQQT | 2932 | GSGSPHSKAQNHLT | 2981 | GSGSPHSKAQSLQI | 3030 | GSGSPHSKAQLQQT | 2984 |
| GSGSPHSKAHNQQR | 2933 | GSGSPHSKAQIGMT | 2982 | GSGSPHSKRLEQQT | 3031 | GSGSPHSKAQKVIT | 3033 |
| GSGSPHSKAQAIKT | 2934 | GSGSPHSKALNKQT | 2983 | GHDSPHKHGQNHQT | 3160 | GHDSPHKSGQWKRT | 3202 |
| GHDSPHKSGQIRQT | 3078 | GHDSPHKSGNQHA | 3119 | LHDSPHKSGQNQQT | 3161 | GHDSPHKSGQSQQI | 3203 |
| GHDSPHKIGQNQHA | 3079 | GHDSPHKSGQTRQT | 3120 | GHDSPHKSVQNKQT | 3162 | GHDSPHKSRQAQQT | 3204 |
| GYDSPHKSGQKQQT | 3080 | GHDSPHKSGNLHT | 3121 | GQVSPHKSGQNQQT | 3163 | GHDSPHKSVQNHQI | 3205 |
| GHDSPHKSGQNQQT | 3081 | GHDSPHKSGLNQQT | 3122 | GHDSPHKSGQRQLT | 3164 | GHDSPHKSKQNQQA | 3206 |
| GHDSPHKSGQSVQT | 3082 | GHDSPHKSAQNQET | 3123 | GHDSPHKIGQNQLT | 3165 | GHDSPHKSAQNQLN | 3207 |
| GHESPHKSGRSQQT | 3083 | GHDSPHKSGQHLQT | 3124 | GHDSPHKSGQIIVT | 3166 | GHDSPHKSGQTQPT | 3208 |
| GHDSPHKSGQNKLE | 3084 | GHDSPHKSRLNQPT | 3125 | IHDSPHKSGQNQQT | 3167 | FHDSPHKSGQNQQT | 3209 |
| GHDSPHKTGQNQQK | 3085 | GHDSPHKSGQKQQT | 3126 | GYDSPHKSGQKQST | 3168 | GHDSPHKLWINQQT | 3210 |
| GRGSPHKRGQNQQT | 3086 | GQDSPHKSGQNQDT | 3127 | MHDSPHKSGQNQQT | 3169 | GPDSPHKSGQNQQT | 3211 |
| GHDNPHKSGQNQQT | 3087 | GHDSPHKSGRNQQT | 3128 | GDDSPHKSVQNQQT | 3170 | GHDSPHKSVQKQLT | 3212 |
| GQDSPHKSGQHQQA | 3088 | GHDSPHKSGQNLLT | 3129 | GHDSPHKSVQSHQT | 3171 | GHDSPHKSGRNQLA | 3213 |
| GHDSPHKSGQIQHT | 3089 | GHDSPHKSGQLVIT | 3130 | GHDSPHKSGQFVVT | 3172 | VHDSPHKSGQNQQS | 3214 |
| GHDSPHKSGPRQQT | 3090 | GHDSPHKSRQSQQT | 3131 | GHDSPHKSRQNLQT | 3173 | GHDSPHKMGRNQQS | 3215 |
| GHDSPHKSGHTQQT | 3091 | GHDSPHKSGRTQET | 3132 | GHNSPHKSGQNQET | 3174 | GHDSPHKSGISIQT | 3216 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GHDSPHKSGQRQHT | 3092 | GHDSPHKSVQTHQT | 3133 | GHDSPHKSAQNQQI | 3175 | VHDSPHKSGQNQQT | 3217 |
| GHDSPHKSAQSQQT | 3093 | GHDSPHKSGNQPA | 3134 | NHDSPHKSGQNQQT | 3176 | GHDSPHKSVQNLQT | 3218 |
| GHESPHKSGQNQQS | 3094 | KHDSPHKSGNQQT | 3135 | GHDSPHKSGQSQPT | 3177 | GHDSPHKMAHNQQT | 3219 |
| GHDSPHKSLQNQQT | 3095 | GHDSPHKSGQTQQT | 3136 | GHESPHKSGQNEQT | 3178 | GHDSPHKHGQNQQN | 3220 |
| GHDSPHKSGRNQET | 3096 | GPDSPHKIGQNQS | 3137 | GHDSPHKSAQNQQT | 3179 | GHDSPHKSVQSQQS | 3221 |
| GHDSPHKSGQTQLT | 3097 | GHDSPHKSVQNQQT | 3138 | GHDSPHKSGQNQLT | 3180 | GHDSPHKSGQTVCT | 3222 |
| GHDSPHKSEKNQQT | 3098 | GHDSPHKSRQDQHT | 3139 | GHDSPHKSAQNLLT | 3181 | GQDSPHKSGQYQQI | 3223 |
| GRDSPHKSGQDQQT | 3099 | GPDSPHKSGQKQQT | 3140 | THDSPHKSGQNQQT | 3182 | GHDSPHKSGQQIMT | 3224 |
| GHDSPHKTGHNQQT | 3100 | GHDSPHKSRQSQHT | 3141 | GNGSPHKRGQNQQT | 3183 | GHDSPHKSRQNEQS | 3225 |
| AHDSPHKSGQNQLT | 3101 | GHDSPHKSVQNQLT | 3142 | GHDSPHKSGQSLQT | 3184 | GHDSPHKSGLNHQT | 3226 |
| GYDSPHKSGQTQQT | 3102 | AHDSPHKSGQNQQT | 3143 | GHDSPHKSAQNHQT | 3185 | GYDSPHKSGQNQQT | 3227 |
| GHESPHKSGQTQQI | 3103 | GQDSPHKSGQNQQS | 3144 | GHDSPHKSGRNRQT | 3186 | GHDSPHKSGQNLQT | 3228 |
| GHDSPHKSGQSKQA | 3104 | GHDSPHKSGRNQQI | 3145 | EHDSPHKSGQNQQT | 3187 | GHDSPHKSRQDQQT | 3229 |
| GHESPHKSGQNQQT | 3105 | GYDSPHKSGQYQHT | 3146 | GHDSPHKYGQNEQT | 3188 | GDDSPHKSGQKQLT | 3230 |
| GHDSPHKTGQNQPP | 3106 | GHDSPHKSRQNQQT | 3147 | RHDSPHKSGHNQQT | 3189 | GDDSPHKSGHNQQT | 3231 |
| GHDSPHKSGQSPQT | 3107 | GHDSPHKSWVRQQT | 3148 | GHDSPHKSQQNQQT | 3190 | GHDSPHKSGQMIHT | 3232 |
| GNDSPHKSVQNQQT | 3108 | GHESPHKSGQNQHS | 3149 | GHDSPHKSGQNQQI | 3191 | GHDSPHKSGRNHQS | 3233 |
| GHDSPHKSAQNYQT | 3109 | GHDSPHKIGHNQQT | 3150 | QHDSPHKSGQNQQT | 3192 | GHDSPHKSVQNRQT | 3234 |
| AHDSPHKIGQNHQT | 3110 | WHDSPHKSGQNQQT | 3151 | RHDSPHKIVQNQQT | 3193 | GHDSPHKSGQKMNT | 3235 |
| GHESPHKSAQNRQT | 3111 | RHDSPHKSGQNQQT | 3152 | YHDSPHKSGQNQQT | 3194 | GHDSPHKSGQSQQN | 3236 |
| GHDSPHKSGQNQQG | 3112 | GHDSPHKSNAWQQT | 3153 | GHDSPHKSVQSKQT | 3195 | GHDSPHKSGQYQHA | 3237 |
| GQDSPHKIGQNQQT | 3113 | GHDSPHKSGQSVPT | 3154 | GNDSPHKIGHNQQT | 3196 | GHDSPHKSGQNQWT | 3117 |
| GHDSPHKSGQNHLT | 3114 | GHESPHKSGQNIQP | 3155 | HHDSPHKSGQNQQT | 3197 | GHDSPHKRGPDQQS | 3158 |
| GHDSPHKSGQYQHT | 3115 | GHDSPHKSVQNHLN | 3156 | GHDSPHKSGQTQQI | 3198 | GHDSPHKSGRDQKT | 3200 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| GNDSPHKSVQNHQT | 3116 | GHDSPHKIGLDQQT | 3157 | GQDSPHKSGQNPLT | 3199 | GHDSPHKSVHNQQN | 3201 |
| GHDSPHKSVQNQHT | 3118 | GHDSPHKSGESQQT | 3159 | KTISKRGSPHSKAQNQQT | 4098 | KGLGGSGSPHSKAQNQQT | 4099 |
| KTINGHDSPHSKAQNLQT | 4100 | KTINGSGSPHSKTCIQQT | 4196 | KEIYGSGSPHSKAQNQQT | 4292 | KTINGSGSPHKRGQKQQT | 4388 |
| KTINGHDSPHSKAQNQQI | 4101 | KTINGSGSPHSKWLTQQT | 4197 | KELSGSGSPHSKAQNQQT | 4293 | KTINGSGSPHKRGQNQET | 4389 |
| KTINGSGSPHFTRQNQQT | 4102 | KTINGSGSPHSKWVVQQT | 4198 | KETIGSGSPHSKAQNQQT | 4294 | KTINGSGSPHKRGQNQLT | 4390 |
| KTINGSGSPHSLPWNQQT | 4103 | KTINGSGSPHSKYRLQQT | 4199 | KEVLGSGSPHSKAQNQQT | 4295 | KTINGSGSPHKRGRNQQT | 4391 |
| KTINGHDSPHSKAQNHQT | 4104 | KTINGSGSPHSKYSKQQT | 4200 | KFALGHDSPHKSGQKQQT | 4296 | KTINGSGSPHKSGGNQQT | 4392 |
| KTMNGHDSPHSKAQNQQT | 4105 | KTINGSGSPHSKYSRQQT | 4201 | KIINGHDSPHKSGQNLVL | 4297 | KTINGSGSPHKSGHNQET | 4393 |
| KPYKGSGSPHSKAQNQQT | 4106 | KTINGSGSPHSLKRNQQT | 4202 | KIINGHDSPHKSGQRNYT | 4298 | KTINGSGSPHKSGHNQLT | 4394 |
| KRLWGSGSPHSKAQNQQT | 4107 | KTINGSGSPHSLWFNQQT | 4203 | KIINGHDSPHSKAQNQQT | 4299 | KTINGSGSPHKSGHNQQN | 4395 |
| KRMRGSGSPHSKAQNQQT | 4108 | KTINGSGSPHSLWPNQQT | 4204 | KLNPGHDSPHKSGQTQQT | 4300 | KTINGSGSPHKSGLNQLT | 4396 |
| KRTYGSGSPHSKAQNQQT | 4109 | KTINGSGSPHSLWTNQQT | 4205 | KLNRGHDSPHKSGNQQS | 4301 | KTINGSGSPHKSGPNQQT | 4397 |
| KTINCLRSPHSKAQNQQT | 4110 | KTINGSGSPHSMRRNQQT | 4206 | KLSSGHDSPHKSGQNQQN | 4302 | KTINGSGSPHKSGQGQT | 4398 |
| KTINFSRSPHSKAQNQQT | 4111 | KTINGSGSPHSPCLNQQT | 4207 | KNINGHDSPHSKAQNQQT | 4303 | KTINGSGSPHKSGQHLQT | 4399 |
| KTINGLRSPHFKAQNQQT | 4112 | KTINGSGSPHSQWQNQQT | 4208 | KNNDGSGSPHSKAQNQQT | 4304 | KTINGSGSPHKSGQHQT | 4400 |
| KTINGNRSPHNKAQNQQT | 4113 | KTINGSGSPHSRCANQQT | 4209 | KNVMGSGSPHSKAQNQQT | 4305 | KTINGSGSPHKSGQKHQT | 4401 |
| KTINGPRSPHYKAQNQQT | 4114 | KTINGSGSPHSRIRNQQT | 4210 | KPINGHDSPHKSGQNKLS | 4306 | KTINGSGSPHKSGQKQQS | 4402 |
| KTINGQASPHWKAQNQQT | 4115 | KTINGSGSPHSRKSNQQT | 4211 | KPINGHDSPHKSGQNLSS | 4307 | KTINGSGSPHKSGQNEQT | 4403 |
| KTINGRCSPHSKAQNQQT | 4116 | KTINGSGSPHSRLWNQQT | 4212 | KPINGHDSPHSKAQNQQT | 4308 | KTINGSGSPHKSGQNHQT | 4404 |
| KTINGRHSPHSKAQNQQT | 4117 | KTINGSGSPHSRRFNQQT | 4213 | KRINGHDSPHSKAQNQQT | 4309 | KTINGSGSPHKSGQNKQT | 4405 |
| KTINGRKSPHRKAQNQQT | 4118 | KTINGSGSPHSRRPNQQT | 4214 | KSCSGHDSPHKSGQNQQS | 4310 | KTINGSGSPHKSGQNKTS | 4406 |
| KTINGRLSPHWKAQNQQT | 4119 | KTINGSGSPHSRSCNQQT | 4215 | KSINGHDSPHKSGQNLAS | 4311 | KTINGSGSPHKSGQNQEA | 4407 |
| KTINGRLSPHYKAQNQQT | 4120 | KTINGSGSPHSRSKNQQT | 4216 | KSINGHDSPHKSGQNLFL | 4312 | KTINGSGSPHKSGQNQET | 4408 |
| KTINGRPSPHMKAQNQQT | 4121 | KTINGSGSPHSRTKNQQT | 4217 | KSINGHDSPHKSGQNLLM | 4313 | KTINGSGSPHKSGQNQKT | 4409 |
| KTINGRSSPHWKAQNQQT | 4122 | KTINGSGSPHSRWLNQQT | 4218 | KSINGHDSPHKSGQNLLQ | 4314 | KTINGSGSPHKSGQNQQI | 4410 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| KTINGRWSPHSKAQNQQT | 4123 | KTINGSGSPHSSVCNQQT | 4219 | KSINGHDSPHKSGQNSLG | 4315 | KTINGSGSPHKSGQNQQR | 4411 |
| KTINGSGSPHAPCQNQQT | 4124 | KTINGSGSPHSSWRNQQT | 4220 | KSINGHDSPHKSGQNTLQ | 4316 | KTINGSGSPHKSGQNQRT | 4412 |
| KTINGSGSPHAWAQNQQT | 4125 | KTINGSGSPHSVCQNQQT | 4221 | KSINGHDSPHKSSSNQQT | 4317 | KTINGSGSPHKSGQNQYT | 4413 |
| KTINGSGSPHCMRQNQQT | 4126 | KTINGSGSPHSVLCNQQT | 4222 | KSINGHDSPHKYKLNQQT | 4318 | KTINGSGSPHKSGQRQQT | 4414 |
| KTINGSGSPHFCSQNQQT | 4127 | KTINGSGSPHSVRRNQQT | 4223 | KSINGSGSPHKSGQKQQT | 4319 | KTINGSGSPHKSGQSQQT | 4415 |
| KTINGSGSPHFLFQNQQT | 4128 | KTINGSGSPHSVSCNQQT | 4224 | KSINGSGSPHKSGQNQQT | 4320 | KTINGSGSPHKSGQYQRT | 4416 |
| KTINGSGSPHFWAQNQQT | 4129 | KTINGSGSPHSWALNQQT | 4225 | KSINGSGSPHSKAQGLST | 4321 | KTINGSGSPHKSGRNQQA | 4417 |
| KTINGSGSPHLCAQNQQT | 4130 | KTINGSGSPHSWITNQQT | 4226 | KSINGSGSPHSKAQLLGT | 4322 | KTINGSGSPHKSRHNQQT | 4418 |
| KTINGSGSPHLRYQNQQT | 4131 | KTINGSGSPHSWPMNQQT | 4227 | KSINGSGSPHSKTSWQQT | 4323 | KTINGSGSPHKSRQYQQT | 4419 |
| KTINGSGSPHLYYQNQQT | 4132 | KTINGSGSPHSWRSNQQT | 4228 | KSMNGHDSPHSKAQNQQT | 4324 | KTINGSGSPHRKAQAPGT | 4420 |
| KTINGSGSPHPLCQNQQT | 4133 | KTINGSGSPHSYFLNQQT | 4229 | KSTLGSGSPHSKAQNQHT | 4325 | KTINGSGSPHSKAAMKQT | 4421 |
| KTINGSGSPHRIRQNQQT | 4134 | KTINGSGSPHSYTYNQQT | 4230 | KSTLGSGSPHSKAQNQQN | 4326 | KTINGSGSPHSKAGRQQT | 4422 |
| KTINGSGSPHRLFQNQQT | 4135 | KTINGSGSPHSYWQNQQT | 4231 | KSTVGSGSPHSKAQTQQT | 4327 | KTINGSGSPHSKAGRTQT | 4423 |
| KTINGSGSPHSCGQNQQT | 4136 | KTINGSGSPHTLCQNQQT | 4232 | KTCKESGSPHSKAQNQQT | 4328 | KTINGSGSPHSKAKSNQT | 4424 |
| KTINGSGSPHSCLRNQQT | 4137 | KTINGSGSPHWLRQNQQT | 4233 | KTCKGSGSPHSKAQNQQT | 4329 | KTINGSGSPHSKALKTQT | 4425 |
| KTINGSGSPHSCLSNQQT | 4138 | KTINGSGSPHWPSQNQQT | 4234 | KTCKSSGSPHSKAQNQQT | 4330 | KTINGSGSPHSKAPRTQT | 4426 |
| KTINGSGSPHSCRLNQQT | 4139 | KTINGSGSPHYLRQNQQT | 4235 | KTDMGSGSPHSKAQNQQT | 4331 | KTINGSGSPHSKAQAART | 4427 |
| KTINGSGSPHSCSLNQQT | 4140 | KTINGSGSPHYTRQNQQT | 4236 | KTDNGIGSPHSKAQNQQT | 4332 | KTINGSGSPHSKAQAILT | 4428 |
| KTINGSGSPHSKACTLQT | 4141 | KTINGSLSPHLWAQNQQT | 4237 | KTEGGSGSPHSKAQNQQT | 4333 | KTINGSGSPHSKAQCRGT | 4429 |
| KTINGSGSPHSKAFRAQT | 4142 | KTINGSPSPHCQAQNQQT | 4238 | KTEHHSGSPHSKAQNQQT | 4334 | KTINGSGSPHSKAQGLRT | 4430 |
| KTINGSGSPHSKAIRKQT | 4143 | KTINGSRSPHLCAQNQQT | 4239 | KTEKDSGSPHSKAQNQQT | 4335 | KTINGSGSPHSKAQKGVL | 4431 |
| KTINGSGSPHSKAQASRT | 4144 | KTINGSRSPHWRAQNQQT | 4240 | KTELGHDSPHKRGQNQQT | 4336 | KTINGSGSPHSKAQKSNT | 4432 |
| KTINGSGSPHSKAQFELT | 4145 | KTINGSVSPHWLAQNQQT | 4241 | KTESVSGSPHSKAQNQQT | 4337 | KTINGSGSPHSKAQNNKF | 4433 |
| KTINGSGSPHSKAQIVIT | 4146 | KTINGTFSPHRKAQNQQT | 4242 | KTETNSGSPHSKAQNQQT | 4338 | KTINGSGSPHSKAQNRRT | 4434 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| KTINGSGSPHSKAQLART | 4147 | KTINGWTSPHRKAQNQQT | 4243 | KTETYSGSPHSKAQNQQT | 4339 | KTINGSGSPHSKAQPKQT | 4435 |
| KTINGSGSPHSKAQLQRT | 4148 | KTINRGISPHSKAQNQQT | 4149 | KTEWLSGSPHSKAQNQQT | 4244 | KTINGSGSPHSKAQRAPT | 4436 |
| KTINGSGSPHSKAQNARR | 4149 | KTINTVRSPHSKAQNQQT | 4149 | KTFNGSGSPHKSGQNQQT | 4245 | KTINGSGSPHSKAQREHT | 4437 |
| KTINGSGSPHSKAQNCPR | 4150 | KTKLRSGSPHSKAQNQQT | 4246 | KTGLRHDSPHKSGQKQQT | 4246 | KTINGSGSPHSKAQRFGT | 4438 |
| KTINGSGSPHSKAQNMRR | 4151 | KTRLRSGSPHSKAQNQQT | 4247 | KTGLRHDSPHKSGQNQQS | 4247 | KTINGSGSPHSKAQRPCT | 4439 |
| KTINGSGSPHSKAQNRRV | 4152 | KWLLGSGSPHSKAQNQQT | 4248 | KTGVTHDSPHKSGQKQQT | 4344 | KTINGSGSPHSKAQRQAT | 4440 |
| KTINGSGSPHSKAQPSRT | 4153 | KWSQGSGSPHSKAQNQQT | 4249 | KTIDGHESPHSKAQNQQT | 4345 | KTINGSGSPHSKAQRQPT | 4441 |
| KTINGSGSPHSKAQQVKT | 4154 | KWYLGSGSPHSKAQNQQT | 4250 | KTIEGHDSPHKSGQTQQT | 4346 | KTINGSGSPHSKAQTKLT | 4442 |
| KTINGSGSPHSKAQQVRT | 4155 | KYHSGSGSPHSKAQNQQT | 4251 | KTIHGHDSPHSKAQNQQT | 4347 | KTINGSGSPHSKAQTTHT | 4443 |
| KTINGSGSPHSKAQRLKT | 4156 | KYLPGSGSPHSKAQNQQT | 4252 | KTIHGHESPHSKAQNQQT | 4348 | KTINGSGSPHSKAQVQRT | 4444 |
| KTINGSGSPHSKAQRRAT | 4157 | KAINGGGSPHSKTQNQQT | 4253 | KTIIGHDSPHKSGQNRSS | 4349 | KTINGSGSPHSKAQVVRT | 4445 |
| KTINGSGSPHSKAQRRGT | 4158 | KAINGHDSPHKRSPNQQT | 4254 | KTIIGHDSPHKSGQRLGT | 4350 | KTINGSGSPHSKAQWPNT | 4446 |
| KTINGSGSPHSKAQRRRT | 4159 | KAINGHDSPHKSFSPQQT | 4255 | KTIIGSGSPHKSGQNQQT | 4351 | KTINGSGSPHSKAQYPST | 4447 |
| KTINGSGSPHSKAQRTRT | 4160 | KAINGHDSPHKSGENQQP | 4256 | KTIKGHDSPHKSGQNMLF | 4352 | KTINGSGSPHSKARALQT | 4448 |
| KTINGSGSPHSKAQRVHT | 4161 | KAINGHDSPHKSGQLART | 4257 | KTILGSGSPHSKAQNLQT | 4353 | KTINGSGSPHSKARDQHT | 4449 |
| KTINGSGSPHSKAQTYRT | 4162 | KAINGHDSPHKSGQNAFL | 4258 | KTINGCSSPHWKAQNQQT | 4354 | KTINGSGSPHSKARFQQT | 4450 |
| KTINGSGSPHSKAQVRKT | 4163 | KAINGHDSPHKSGQNAYT | 4259 | KTINGGGSTHSKAQNQQT | 4355 | KTINGSGSPHSKARRTQT | 4451 |
| KTINGSGSPHSKARGRQT | 4164 | KAINGHDSPHKSGQNFAS | 4260 | KTINGHDSPHKAGQSQQT | 4356 | KTINGSGSPHSKARSLQT | 4452 |
| KTINGSGSPHSKARLCQT | 4165 | KAINGHDSPHKSGQNLAS | 4261 | KTINGHDSPHKRGQNVPS | 4357 | KTINGSGSPHSKARVIQT | 4453 |
| KTINGSGSPHSKARLKQT | 4166 | KAINGHDSPHKSGQNLGS | 4262 | KTINGHDSPHKRGRSYQT | 4358 | KTINGSGSPHSKAWYLQT | 4454 |
| KTINGSGSPHSKARNSQT | 4167 | KAINGHDSPHKSGQNLKF | 4263 | KTINGHDSPHKTGQNPPT | 4359 | KTINGSGSPHSKGGGQQT | 1455 |
| KTINGSGSPHSKARWVQT | 4168 | KAINGHDSPHKSGQNLLK | 4264 | KTINGHDSPHSKAENQQT | 4360 | KTINGSGSPHSKGSRQQT | 4456 |
| KTINGSGSPHSKAVRWQT | 4169 | KAINGHDSPHKSGQNLSR | 4265 | KTINGHDSPHSKALSLQT | 4361 | KTINGSGSPHSKLQRQQT | 4457 |
| KTINGSGSPHSKAYTRQT | 4170 | KAINGHDSPHKSGQNLSS | 4266 | KTINGHDSPHSKAQGQQT | 4362 | KTINGSGSPHSKMLRQQT | 4458 |
| KTINGSGSPHSKCQSQQT | 4171 | KAINGHDSPHKSGQNSLG | 4267 | KTINGHDSPHSKAQHQQT | 4363 | KTINGSGSPHSKSSIKQT | 4459 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| KTINGSGSPHSKFLRQQT | 4172 | KAINGHDSPHKSGQNTLQ | 4268 | KTINGHDSPHSKAQIQQT | 4364 | KTINGSGSPHSKVRFQQT | 4460 |
| KTINGSGSPHSKFRFQQT | 4173 | KAINGHDSPHKSGQNTSL | 4269 | KTINGHDSPHSKAQKQQT | 4365 | KTINGSGSPHSVVWNQQT | 4461 |
| KTINGSGSPHSKFRLQQT | 4174 | KAINGHDSPHKSGQRLGT | 4270 | KTINGHDSPHSKAQNLSS | 4366 | KTINGSTSPHKLAQNQQP | 4462 |
| KTINGSGSPHSKFRRQQT | 4175 | KAINGHDSPHKSGQRNYT | 4271 | KTINGHDSPHSKAQNPQT | 4367 | KTINRHDSPHKSGQRPST | 4463 |
| KTINGSGSPHSKGMKQQT | 4176 | KAINGHDSPHKSGQRPST | 4272 | KTINGHDSPHSKAQNQET | 4368 | KTINRIMSPHSKAQNQQT | 4464 |
| KTINGSGSPHSKKLRQQT | 4177 | KAINGHDSPHKSGQRPVT | 4273 | KTINGHDSPHSKAQNQHT | 4369 | KTINTARSPHSKAQNQQT | 4465 |
| KTINGSGSPHSKKRPQQT | 4178 | KAINGHDSPHKSGQVPST | 4274 | KTINGHDSPHSKAQNQLT | 4370 | KTISGHDSPHSKAQNQQT | 4466 |
| KTINGSGSPHSKKSRQQT | 4179 | KAINGHDSPHKSLSNQQT | 4275 | KTINGHDSPHSKAQNQPT | 4371 | KTISGSGSPHKSGQNQQT | 4467 |
| KTINGSGSPHSKLYRQQT | 4180 | KAINGHDSPHKSVLSQQT | 4276 | KTINGHDSPHSKAQNQQA | 4372 | KTITGHDSPHKSGQRLGT | 4468 |
| KTINGSGSPHSKLYWQQT | 4181 | KAINGHDSPHKTLQNQQT | 4277 | KTINGHDSPHSKAQNTGS | 4373 | KTITGSGSPHKSGQNQQT | 4469 |
| KTINGSGSPHSKPRMQQT | 4182 | KAINGHNSPHKSAQNQQT | 4278 | KTINGHDSPHSKAQSQQT | 4374 | KTIYGHDSPHKSGQRLGT | 4470 |
| KTINGSGSPHSKRFPQQT | 4183 | KAINGLDSPHSKAQNQQT | 4279 | KTINGHDSPHSKAQTQQT | 4375 | KTLNGHDSPHKSGQNLFL | 4471 |
| KTINGSGSPHSKRFRQQT | 4184 | KAINGSGSPHKSGQNQQT | 4280 | KTINGHDSPHSKAQYQQT | 4376 | KTLNGHDSPHKSGQNLSS | 4472 |
| KTINGSGSPHSKRPYQQT | 4185 | KAINGSGSPHSKAQGQQT | 4281 | KTINGHDSPHSKARNQQT | 4377 | KTLSFHDSPHKSGQNQQS | 4473 |
| KTINGSGSPHSKRRMQQT | 4186 | KAINGSGSPHSKAQLSGT | 4282 | KTINGHDSPHSKLPGQQT | 4378 | KTSNGSGSPHSKAQNTMT | 4474 |
| KTINGSGSPHSKRSKQQT | 4187 | KAINGSGSPHSKAQNGSL | 4283 | KTINGHDSPHSKSPNQQT | 4379 | KTTNGHDSPHSKAQNQQT | 4475 |
| KTINGSGSPHSKRSRQQT | 4188 | KAINGSGSPHSKAQNSLL | 4284 | KTINGHESPHKSGQNAFL | 4380 | KTVNGGGSPHSKAQNQQT | 4476 |
| KTINGSGSPHSKRTMQQT | 4189 | KAINGSGSPHSKAVGLQT | 4285 | KTINGIGSPHSKAPNEQT | 4381 | KTVNGHDSPHKSGQNVSL | 4477 |
| KTINGSGSPHSKRTRQQT | 4190 | KAINGSGSPHSKSLLQQT | 4286 | KTINGQDSPHKSGQNLHM | 4382 | KTVNGHDSPHKSGQRPST | 4478 |
| KTINGSGSPHSKRVRQQT | 4191 | KAINGRGSPHSKSLPQQT | 4287 | KTINGHDSPHSKAQIGMT | 4383 | KTVNGHDSPHKSGQTQQA | 4479 |
| KTINGSGSPHSKRYIQQT | 4192 | KAINGRGSPHSKSTFQQT | 4288 | KTINGRGSPHSKAQNQVL | 4384 | KTVNGHESPHSKAQNQQT | 4480 |
| KTINGSGSPHSKRYNQQT | 4193 | KAITGHDSPHSKAQNQQT | 4289 | KTINGRGSPHSKAQSPTT | 4385 | KTVNGSGSPHSKAQGLST | 4481 |
| KTINGSGSPHSKRYPQQT | 4194 | KDVMGSGSPHSKAQNQQT | 4290 | KTINGRGSPHSKATSFQT | 4386 | KTVNGSGSPHSKAQNVTS | 4482 |
| KTINGSGSPHSKRYSQQT | 4195 | KEIVGSGSPHSKAQNQQT | 4291 | KTINGSGSPHFVVQNQQT | 4387 | KTVPASGSPHSKAQNQQT | 4483 |

TABLE 1-continued

Exemplary Peptide Sequences

| Peptide Sequence | SEQ ID NO: | Peptide Sequence | SEQ ID NO: | Peptide Sequence | SEQ ID NO: | Peptide Sequence | SEQ ID NO: |
|---|---|---|---|---|---|---|---|
| NTINGSGSPHSKAHNQQT | 4484 | TTINGGGSPHSKAQNQQT | 4485 | | | | |

TABLE 2A

Exemplary Peptide Sequences

| SEQ ID NO: | Amino Acid Sequence | SEQ ID NO: | Nucleotide Sequence |
|---|---|---|---|
| 941 | SPHSKA | 942 | AGCCCACACAGCAAAGCA |
| 943 | HDSPHKSG | 944 | CACGACAGCCCACACAAAAGCGGA |
| 2 | HDSPHK | 3 | CACGACAGCCCACACAAA |

TABLE 2B

Exemplary Peptide Sequences

| Amino Acid Sequence | SEQ ID NO: | Amino Acid Sequence | SEQ ID NO: | Amino Acid Sequence | SEQ ID NO: | Amino Acid Sequence | SEQ ID NO: |
|---|---|---|---|---|---|---|---|
| SPHSKA | 945 | SPHKKN | 954 | SPHKTS | 963 | SPHTRG | 972 |
| SPHKSG | 946 | SPHVRM | 955 | SPHKTT | 964 | SPHVRG | 973 |
| SPHARM | 947 | SPHRKA | 956 | SPHKTY | 965 | SPHKRG | 974 |
| SPHVKS | 948 | SPHKFG | 957 | SPHKYG | 966 | SPHGAR | 975 |
| SPHASR | 949 | SPHKIG | 958 | SPHSKD | 967 | SPHRSG | 976 |
| SPHVKI | 950 | SPHKLG | 959 | SPHSKP | 968 | SPHKSA | 977 |
| SPHKSR | 951 | SPHSKL | 960 | SPHSRA | 969 | SPHSKR | 978 |
| SPHSLR | 952 | SPHSRG | 961 | SPHSSR | 970 | SPHFLR | 979 |
| SPHSKW | 953 | SPHSKS | 962 | SPHWKA | 971 | SPHVRR | 980 |
| STHASR | 985 | SQHKSG | 986 | HDSPHK | 2 | HDSPHKA | 4486 |

In some embodiments, the peptide comprises an amino acid sequence having the formula [N1]-[N2]-[1N3], wherein [1N2] comprises the amino acid sequence of SPH and [1N3] comprises X4, X5, and X6, wherein at least one of X4, X5, or X6 is a basic amino acid, e.g., a K or R. In some embodiments, position X4 of [1N2] is K. In some embodiments, position X5 of [1N2] is K.

In some embodiments, [N1] comprises X1, X2, and X3, wherein at least one of X1, X2, or X3 is G. In some embodiments, position X1 of [N1] is G, V, R, D, E, M, P, W, or C. In some embodiments, position X2 of [N1] is: S, V, L, N, D, H, R, P, G, T, I, A, E, Y, M, or Q. In some embodiments, position X3 of [N1] is: G, C, L, D, E, Y, H, V, A, N, P, or S. In some embodiments, [N1] comprises GS, SG, GH, HD, GQ, QD, VS, CS, GR, RG, QS, SH, MS, RN, TS, IS, GP, ES, SS, GN, AS, NS, LS, GG, KS, GT, PS, RS, GI, WS, DS, ID, GL, DA, DG, ME, EN, KN, KE, AI, NG, PG, TG, SV, IG, LG, AG, EG, SA, YD, HE, HG, RD, ND, PD, MG, QV, DD, HN, HP, GY, GM, GD, or HS. In some embodiments, [N1] comprises GS, SG, GH, or HD. In some embodiments [N1] is or comprises GSG, GHD, GQD, VSG, CSG, GRG, CSH, GQS, GSH, RVG, GSC, GLL, GDD, GHE, GNY, MSG, RNG, TSG, ISG, PPG, ESG, SSG, GNG, ASG, NSG, LSG, GGG, KSG, HSG, GTG, PSG, GSV, RSG, GIG, WSG, DSG, IDG, GLG, DAG, DGG, MEG, ENG, GSA, KNG, KEG, AIG, GYD, GHG, GRD, GND, GPD, GMG, GQV, GHN, GHP, or GHS. In some embodiments, [N1] is or comprises GSG. In some embodiments, [N1] is or comprises GHD. In some embodiments, [N1]-[N2] comprises SGSPH (SEQ ID NO: 4752), HDSPH (SEQ ID NO: 4703), QDSPH (SEQ ID NO: 4753), RGSPH (SEQ ID NO: 4754), SHSPH (SEQ ID NO: 4755), QSSPH (SEQ ID NO: 4756), DDSPH (SEQ ID NO: 4757), HESPH (SEQ ID NO: 4758), NYSPH (SEQ ID NO: 4759), VGSPH (SEQ ID NO: 4760), SCSPH (SEQ ID NO: 4761), LLSPH (SEQ ID NO: 4762), NGSPH (SEQ ID NO: 4763), PGSPH (SEQ ID NO: 4764), GGSPH (SEQ ID NO: 4765), TGSPH (SEQ ID NO: 4766), SVSPH (SEQ ID NO: 4767), IGSPH (SEQ ID NO: 4768), DGSPH (SEQ ID NO: 4769), LGSPH (SEQ ID NO: 4770), AGSPH (SEQ ID NO: 4771), EGSPH (SEQ ID NO: 4772), SASPH (SEQ ID NO: 4773), YDSPH (SEQ ID NO: 4774), HGSPH (SEQ ID NO: 4775), RDSPH (SEQ ID NO: 4776), NDSPH (SEQ ID NO: 4777), PDSPH (SEQ ID NO: 4778), MGSPH (SEQ ID NO: 4779), QVSPH (SEQ ID NO: 4780), HNSPH (SEQ ID NO: 4781), HPSPH (SEQ ID NO: 4782), or HSSPH (SEQ ID NO: 4783); an amino acid sequence comprising any portion of any of the aforesaid amino acid sequences (e.g., any 2, 3, or 4 amino acids, e.g., consecutive amino acids) thereof; an amino acid sequence comprising one, two, or three but no more than four modifications, e.g., substitutions (e.g., conservative substitutions), insertions, or deletions, relative to any of the aforesaid amino acid sequences; or an amino acid sequence comprising one, two, or three but no more than four different amino acids, relative to any one of the aforesaid amino acid sequences. In some embodiments, [N1]-[N2] is or comprises GSGSPH (SEQ ID NO: 4695), GHDSPH (SEQ ID NO: 4784), GQDSPH (SEQ ID NO: 4785), VSGSPH (SEQ ID NO: 4786), CSGSPH (SEQ ID NO: 4787), GRGSPH (SEQ ID NO: 4788), CSHSPH (SEQ ID NO: 4789), GQSSPH (SEQ ID NO: 4790), GSHSPH (SEQ ID NO: 4791), GDDSPH (SEQ ID NO: 4792), GHESPH (SEQ ID NO: 4793), GNYSPH (SEQ ID NO: 4794), RVGSPH (SEQ ID NO: 4795), GSCSPH (SEQ ID NO: 4796), GLLSPH (SEQ ID NO: 4797), MSGSPH (SEQ ID NO: 4798), RNGSPH (SEQ ID NO: 4799), TSGSPH (SEQ ID NO: 4800), ISGSPH (SEQ ID NO: 4801), GPGSPH (SEQ ID NO: 4802), ESGSPH (SEQ ID NO: 4803), SSGSPH (SEQ ID NO: 4804), GNGSPH (SEQ ID NO: 4805), ASGSPH (SEQ ID NO: 4806), NSGSPH (SEQ ID NO: 4807), LSGSPH (SEQ ID NO: 4808), GGGSPH (SEQ ID NO: 4809), KSGSPH (SEQ ID NO: 4810), HSGSPH (SEQ ID NO: 4811), GTGSPH (SEQ ID NO: 4812), PSGSPH (SEQ ID NO: 4813), GSVSPH (SEQ ID NO: 4814), RSGSPH (SEQ ID NO: 4815), GIGSPH (SEQ ID NO: 4816), WSGSPH (SEQ ID NO: 4817), DSGSPH (SEQ ID NO: 4818), IDGSPH (SEQ ID NO: 4819), GLGSPH (SEQ ID NO: 4820), DAGSPH (SEQ ID NO: 4821), DGGSPH (SEQ ID NO: 4822), MEGSPH (SEQ ID NO: 4823), ENGSPH (SEQ ID NO: 4824), GSASPH (SEQ ID NO: 4825), KNGSPH (SEQ ID NO: 4826), KEGSPH (SEQ ID NO: 4827), AIGSPH (SEQ ID NO: 4828), GYDSPH (SEQ ID NO: 4829), GHGSPH (SEQ ID NO: 4830), GRDSPH (SEQ ID NO: 4831), GNDSPH (SEQ ID NO: 4832), GPDSPH (SEQ ID NO: 4833), GMGSPH (SEQ ID NO: 4834), GQVSPH (SEQ ID NO: 4835), GHNSPH (SEQ ID NO: 4836), GHPSPH (SEQ ID NO: 4837), or GHSSPH (SEQ ID NO: 4838); an amino acid sequence comprising any portion of any of the aforesaid amino acid sequences (e.g., any 2, 3, 4, or 5 amino acids, e.g., consecutive amino acids) thereof; an amino acid sequence comprising one, two, or three but no more than four modifications, e.g., substitutions (e.g., conservative substitutions), insertions, or deletions, relative to any of the aforesaid amino acid sequences; or an amino acid sequence comprising one, two, or three but no more than four different amino acids, relative to any one of the aforesaid amino acid sequences. In some embodiments, [N1]-[N2] is or comprises GSGSPH (SEQ ID NO: 4695). In some embodiments, [N1]-[N2] is or comprises GHDSPH (SEQ ID NO: 4784).

In some embodiments, X4, X5, or both of [N3] are K. In some embodiments, X4, X5, or X6 of [N3] is R. In some embodiments, position X4 of [N3] is: A, K, V, S, T, G, F, W, V, N, or R. In some embodiments, position X5 of [N3] is: S, K, T, F, I, L, Y, H, M, or R. In some embodiments, position X6 of [N3] is: G, R, A, M, I, N, T, Y, D, P, V, L, E, W, N, Q, K, or S. In some embodiments, [N3] comprises SK, KA, KS, AR, RM, VK, AS, SR, VK, KR, KK, KN, VR, RS, RK, KT, TS, KF, FG, KI, IG, KL, LG, TT, TY, KY, YG, KD, KP, TR, RG, VR, GA, SL, SS, FL, WK, SA, RA, LR, KW, RR, GK, TK, NK, AK, KV, KG, KH, KM, TG, SE, SV, SW, SN, HG, SQ, LW, MG, MA, or SG. In some embodiments, [N3] comprises SK, KA, KS, or SG. In some embodiments, [N3] is or comprises SKA, KSG, ARM, VKS, ASR, VKI, KKN, VRM, RKA, KTS, KFG, KIG, KLG, KTT, KTY, KYG, SKD, SKP, TRG, VRG, KRG, GAR, KSA, KSR, SKL, SRA, SKR, SLR, SRG, SSR, FLR, SKW, SKS, WKA, VRR, SKV, SKT, SKG, GKA, TKA, NKA, SKL, SKN, AKA, KTG, KSL, KSE, KSV, KSW, KSN, KHG, KSQ, KSK, KLW, WKG, KMG, KMA, or RSG. In some embodiments, [N3] is or comprises SKA. In some embodiments, [N3] is or comprises KSG. In some embodiments, [N2]-[N3] comprises SPHSK (SEQ ID NO: 4701), SPHKS (SEQ ID NO: 4704), SPHAR (SEQ ID NO: 4705), SPHVK (SEQ ID NO: 4706), SPHAS (SEQ ID NO: 4707), SPHKK (SEQ ID NO: 4708), SPHVR (SEQ ID NO: 4709), SPHRK (SEQ ID NO: 4710), SPHKT (SEQ ID NO: 4711), SPHKF (SEQ ID NO: 4712), SPHKI (SEQ ID NO: 4713), SPHKL (SEQ ID NO: 4714), SPHKY (SEQ ID NO: 4715), SPHTR (SEQ ID NO: 4716), SPHKR (SEQ ID NO: 4717), SPHGA (SEQ ID NO: 4718), SPHSR (SEQ ID NO: 4719), SPHSL (SEQ ID NO: 4720), SPHSS (SEQ ID NO: 4721), SPHFL (SEQ ID NO: 4722), SPHWK (SEQ ID NO: 4723), SPHGK (SEQ ID NO: 4724), SPHTK (SEQ ID NO: 4725), SPHNK (SEQ ID NO: 4726), SPHAK (SEQ ID NO: 4727), SPHKH (SEQ ID NO: 4728), SPHKM (SEQ ID NO: 4729), or SPHRS (SEQ ID NO: 4730). In some embodiments [N2]-[N3] comprises SPHSK (SEQ ID NO: 4701) or SPHKS (SEQ ID NO: 4704). In some embodiments, [N2]-[N3] is or comprises SPHSKA (SEQ ID NO: 941), SPHKSG (SEQ ID NO: 946), SPHARM (SEQ ID NO: 947), SPHVKS (SEQ ID NO: 948), SPHASR (SEQ ID NO: 949), SPHVKI (SEQ ID NO: 950), SPHKKN (SEQ ID NO: 954), SPHVRM (SEQ ID NO: 955), SPHRKA (SEQ ID NO: 956), SPHKFG (SEQ ID NO: 957), SPHKIG (SEQ ID NO: 958), SPHKLG (SEQ ID NO: 959), SPHKTS (SEQ ID NO: 963), SPHKTT (SEQ ID NO: 964), SPHKTY (SEQ ID NO: 965), SPHKYG (SEQ ID NO: 966), SPHSKD (SEQ ID NO: 967), SPHSKP (SEQ ID NO: 968), SPHTRG (SEQ ID NO: 972), SPHVRG (SEQ ID NO: 973), SPHKRG (SEQ ID NO: 974), SPHGAR (SEQ ID NO: 975), SPHKSA (SEQ ID NO: 977), SPHKSR (SEQ ID NO: 951), SPHSKL (SEQ ID NO: 960), SPHSRA (SEQ ID NO: 969), SPHSKR (SEQ ID NO: 978), SPHSLR (SEQ ID NO: 952), SPHSRG (SEQ ID NO: 961), SPHSSR (SEQ ID NO: 970), SPHFLR (SEQ ID NO: 979), SPHSKW (SEQ ID NO: 953), SPHSKS (SEQ ID NO: 962), SPHWKA (SEQ ID NO: 971), SPHVRR (SEQ ID NO: 980), SPHSKT (SEQ ID NO: 4731), SPHSKG (SEQ ID NO: 4732), SPHGKA (SEQ ID NO: 4733), SPHNKA (SEQ ID NO: 4734), SPHSKN (SEQ ID NO: 4735), SPHAKA (SEQ ID NO: 4736), SPHSKV (SEQ ID NO: 4737), SPHKTG (SEQ ID NO: 4738), SPHTKA (SEQ ID NO: 4739), SPHKSL (SEQ ID NO: 4740), SPHKSE (SEQ ID NO: 4741), SPHKSV (SEQ ID NO: 4742), SPHKSW (SEQ ID NO: 4743), SPHKSN (SEQ ID NO: 4744), SPHKHG (SEQ ID NO: 4745), SPHKSQ (SEQ ID NO: 4746), SPHKSK (SEQ ID NO: 4747), SPHKLW (SEQ ID NO: 4748), SPHWKG (SEQ ID NO: 4749), SPHKMG (SEQ ID NO: 4750), SPHKMA (SEQ ID NO: 4751), or SPHRSG (SEQ ID NO: 976). In some embodiments, [N2]-[N3] is or comprises SPHSKA (SEQ ID NO: 941). In some embodiments, [N2]-[N3] is or comprises SPHKSG (SEQ ID NO: 946).

In some embodiments, [N1]-[N2]-[N3] comprises SGSPHSK (SEQ ID NO: 4839), HDSPHKS (SEQ ID NO: 4840), SGSPHAR (SEQ ID NO: 4841), SGSPHVK (SEQ ID NO: 4842), QDSPHKS (SEQ ID NO: 4843), SGSPHKK (SEQ ID NO: 4844), SGSPHVR (SEQ ID NO: 4845), SGSPHAS (SEQ ID NO: 4846), SGSPHRK (SEQ ID NO: 4847), SGSPHKT (SEQ ID NO: 4848), SHSPHKS (SEQ ID NO: 4849), QSSPHRS (SEQ ID NO: 4850), RGSPHAS (SEQ ID NO: 4851), RGSPHSK (SEQ ID NO: 4852), SGSPHKF (SEQ ID NO: 4853), SGSPHKI (SEQ ID NO: 4854), SGSPHKL (SEQ ID NO: 4855), SGSPHKY (SEQ ID NO: 4856), SGSPHTR (SEQ ID NO: 4857), SHSPHKR (SEQ ID NO: 4858), SGSPHGA (SEQ ID NO: 4859), HDSPHKR (SEQ ID NO: 4860), DDSPHKS (SEQ ID NO: 4861), HESPHKS (SEQ ID NO: 4862), NYSPHKI (SEQ ID NO: 4863), SGSPHSR (SEQ ID NO: 4864), SGSPHSL (SEQ ID NO: 4865), SGSPHSS (SEQ ID NO: 4866), VGSPHSK (SEQ ID NO: 4867), SCSPHRK (SEQ ID NO: 4868), SGSPHFL (SEQ ID NO: 4869), LLSPHWK (SEQ ID NO: 4870), NGSPHSK (SEQ ID NO: 4871), PGSPHSK (SEQ ID NO: 4872), GGSPHSK (SEQ ID NO: 4873), TGSPHSK (SEQ ID NO: 4874), SVSPHGK (SEQ ID NO: 4875), SGSPHTK (SEQ ID NO: 4876), IGSPHSK (SEQ ID NO: 4877), DGSPHSK (SEQ ID NO: 4878), SGSPHNK (SEQ ID NO: 4879), LGSPHSK (SEQ ID NO: 4880), AGSPHSK (SEQ ID NO: 4881), EGSPHSK (SEQ ID NO: 4882), SASPHSK (SEQ ID NO: 4883), SGSPHAK (SEQ ID NO: 4884), HDSPHKI (SEQ ID NO: 4885), YDSPHKS (SEQ ID NO: 4886), HDSPHKT (SEQ ID NO: 4887), RGSPHKR (SEQ ID NO: 4888), HGSPHSK (SEQ ID NO: 4889), RDSPHKS (SEQ ID NO: 4890), NDSPHKS (SEQ ID NO: 4891), QDSPHKI (SEQ ID NO: 4892), PDSPHKI (SEQ ID NO: 4893), PDSPHKS (SEQ ID NO: 4894), MGSPHSK (SEQ ID NO: 4895), HDSPHKH (SEQ ID NO: 4896), QVSPHKS (SEQ ID NO: 4897), HNSPHKS (SEQ ID NO: 4898), NGSPHKR (SEQ ID NO: 4899), HDSPHKY (SEQ ID NO: 4900), NDSPHKI (SEQ ID NO: 4901), HDSPHKL (SEQ ID NO: 4902), HPSPHWK (SEQ ID NO: 4903), HDSPHKM (SEQ ID NO: 4904), or HSSPHRS (SEQ ID NO: 4905). In some embodiments, [N1]-[N2]-[N3] is GSGSPHSKA (SEQ ID NO: 4697), GHDSPHKSG (SEQ ID NO: 4698), GSGSPHARM (SEQ ID NO: 4906), GSGSPHVKS (SEQ ID NO: 4907), GQDSPHKSG (SEQ ID NO: 4908), GSGSPHASR (SEQ ID NO: 4909), GSGSPHVKI (SEQ ID NO: 4910), GSGSPHKKN (SEQ ID NO: 4911), GSGSPHVRM (SEQ ID NO: 4912), VSGSPHSKA (SEQ ID NO: 4913), CSGSPHSKA (SEQ ID NO: 4914), GSGSPHRKA (SEQ ID NO: 4915), CSGSPHKTS (SEQ ID NO: 4916), CSHSPHKSG (SEQ ID NO: 4917), GQSSPHRSG (SEQ ID NO: 4918), GRGSPHASR (SEQ ID NO: 4919), GRGSPHSKA (SEQ ID NO: 4920), GSGSPHKFG (SEQ ID NO: 4921), GSGSPHKIG (SEQ ID NO: 4922), GSGSPHKLG (SEQ ID NO: 4923), GSGSPHKTS (SEQ ID NO: 4924), GSGSPHKTT (SEQ ID NO: 4925), GSGSPHKTY (SEQ ID NO: 4926), GSGSPHKYG (SEQ ID NO: 4927), GSGSPHSKD (SEQ ID NO: 4928), GSGSPHSKP (SEQ ID NO: 4929), GSGSPHTRG (SEQ ID NO: 4930), GSGSPHVRG (SEQ ID NO: 4931), GSHSPHKRG (SEQ ID NO: 4932), GSHSPHKSG (SEQ ID NO: 4933), VSGSPHASR (SEQ ID NO: 4934), VSGSPHGAR (SEQ ID NO: 4935), VSGSPHKFG (SEQ ID NO: 4936), GHDSPHKRG (SEQ ID NO: 4937), GDDSPHKSG (SEQ ID NO: 4938), GHESPHKSA (SEQ ID NO: 4939), GHDSPHKSA (SEQ ID NO: 4940), GNYSPHKIG (SEQ ID NO: 4941), GHDSPHKSR (SEQ ID NO: 4942), GSGSPHSKL (SEQ ID NO: 4943), GSGSPHSRA (SEQ ID NO: 4944), GSGSPHSKR (SEQ ID NO: 4945), GSGSPHSLR (SEQ ID NO: 4946), GSGSPHSRG (SEQ ID NO: 4947), GSGSPHSSR (SEQ ID NO: 4948), RVGSPHSKA (SEQ ID NO: 4949), GSCSPHRKA (SEQ ID NO: 4950), GSGSPHFLR (SEQ ID NO: 4951), GSGSPHSKW (SEQ ID NO: 4952), GSGSPHSKS (SEQ ID NO: 4953), GLLSPHWKA (SEQ ID NO: 4954), GSGSPHVRR (SEQ ID NO: 4955), GSGSPHSKV (SEQ ID NO: 4956), MSGSPHSKA (SEQ ID NO: 4957), RNGSPHSKA (SEQ ID NO: 4958), TSGSPHSKA (SEQ ID NO: 4959), ISGSPHSKA (SEQ ID NO: 4960), GPGSPHSKA (SEQ ID NO: 4961), GSGSPHSKT (SEQ ID NO: 4962), ESGSPHSKA (SEQ ID NO: 4963), SSGSPHSKA (SEQ ID NO: 4964), GNGSPHSKA (SEQ ID NO: 4965), ASGSPHSKA (SEQ ID NO: 4966), NSGSPHSKA (SEQ ID NO: 4967), LSGSPHSKA (SEQ ID NO: 4968), GGGSPHSKA (SEQ ID NO: 4969), KSGSPHSKA (SEQ ID NO: 4970), GGGSPHSKS (SEQ ID NO: 4971), GSGSPHSKG (SEQ ID NO: 4972), HSGSPHSKA (SEQ ID NO: 4973), GTGSPHSKA (SEQ ID NO: 4974), PSGSPHSKA (SEQ ID NO: 4975), GSVSPHGKA (SEQ ID NO: 4976), RSGSPHSKA (SEQ ID NO: 4977), GSGSPHTKA (SEQ ID NO: 4978), GIGSPHSKA (SEQ ID NO: 4979), WSGSPHSKA (SEQ ID NO: 4980), DSGSPHSKA (SEQ ID NO: 4981), IDGSPHSKA (SEQ ID NO: 4982), GSGSPHNKA (SEQ ID NO: 4983), GLGSPHSKS (SEQ ID NO: 4984), DAGSPHSKA (SEQ ID NO: 4985), DGGSPHSKA (SEQ ID NO: 4986), MEGSPHSKA (SEQ ID NO: 4987), ENGSPHSKA (SEQ ID NO: 4988), GSASPHSKA (SEQ ID NO: 4989), GNGSPHSKS (SEQ ID NO: 4990), KNGSPHSKA (SEQ ID NO: 4991), KEGSPHSKA (SEQ ID NO: 4992), AIGSPHSKA (SEQ ID NO: 4993), GSGSPHSKN (SEQ ID NO: 4994), GSGSPHAKA (SEQ ID NO: 4995), GHDSPHKIG (SEQ ID NO: 4996), GYDSPHKSG (SEQ ID NO: 4997), GHESPHKSG (SEQ ID NO: 4998), GHDSPHKTG (SEQ ID NO: 4999), GRGSPHKRG (SEQ ID NO: 5000), GQDSPHKSG (SEQ ID NO: 4908), GHDSPHKSL (SEQ ID NO: 5001), GHGSPHSKA (SEQ ID NO: 5002), GHDSPHKSE (SEQ ID NO: 5003), VSGSPHSKA (SEQ ID NO: 4913), GRDSPHKSG (SEQ ID NO: 5004), GNDSPHKSV (SEQ ID NO: 5005), GQDSPHKIG (SEQ ID NO: 5006), GHDSPHKSV (SEQ ID NO: 5007), GPDSPHKIG (SEQ ID NO: 5008), GPDSPHKSG (SEQ ID NO: 5009), GHDSPHKSW (SEQ ID NO: 5010), GHDSPHKSN (SEQ ID NO: 5011), GMGSPHSKT (SEQ ID NO: 5012), GHDSPHKHG (SEQ ID NO: 5013), GQVSPHKSG (SEQ ID NO: 5014), GDDSPHKSV (SEQ ID NO: 5015), GHNSPHKSG (SEQ ID NO: 5016), GNGSPHKRG (SEQ ID NO: 5017), GHDSPHKYG (SEQ ID NO: 5018), GHDSPHKSQ (SEQ ID NO: 5019), GNDSPHKIG (SEQ ID NO: 5020), GHDSPHKSK (SEQ ID NO: 5021), GHDSPHKLW (SEQ ID NO: 5022), GHPSPHWKG (SEQ ID NO: 5023), GHDSPHKMG (SEQ ID NO: 5024), GHDSPHKMA (SEQ ID NO: 5025), or GHSSPHRSG (SEQ ID NO: 5026); an amino acid sequence comprising any portion of any of the aforesaid amino acid sequences (e.g., any 2, 3, 4, 5, 6, 7, or 8 amino acids, e.g., consecutive amino acids) thereof; an amino acid sequence comprising one, two, or three but no more than four modifications, e.g., substitutions (e.g., conservative substitutions), insertions, or deletions, relative to any of the aforesaid amino acid sequences; or an amino acid sequence comprising one, two, or three but no more than four different amino acids, relative to any one of the aforesaid amino acid sequences. In some embodiments, [N1]-[N2]-[N3] is or comprises GSGSPHSKA (SEQ ID NO: 4697). In some embodiments, [N1]-[N2]-[N3] is or comprises GHDSPHKSG (SEQ ID NO: 4698).

In some embodiments, the peptide comprising an amino acid sequence having the formula [N1]-[N2]-[N3], further comprises [N4] which comprises X7 X8 X9 X10. In some embodiments, position X7 of [N4] is W, Q, K, R, G, L, V, S, P, H, K, I, M, A, E, or F. In some embodiments, position X8 of [N4] is N, Y, C, K, T, H, R, D, V, S, P, G, W, E, F, A, I, M, Q, or L. In some embodiments, position X9 of [N4] is Q, G, K, H, R, T, L, D, A, P, I, F, V, M, W, Y, S, E, N, or Y. In some embodiments, position X10 of [N4] is Q, H, L, R, W, K, A, P, E, M, I, S, G, N, Y, C, V, T, D, or V. In some embodiments [N4] is or comprises QNQQ (SEQ ID NO: 5028), WNQQ (SEQ ID NO: 5029), QYYV (SEQ ID NO:

5030), RRQQ (SEQ ID NO: 5031), QNQQ (SEQ ID NO: 5033), GCGQ (SEQ ID NO: 5032), LRQQ (SEQ ID NO: 5033), RNQQ (SEQ ID NO: 5034), VNQQ (SEQ ID NO: 5035), FRLQ (SEQ ID NO: 5036), FNQQ (SEQ ID NO: 5037), LLQQ (SEQ ID NO: 5038), SNQQ (SEQ ID NO: 5039), RLQQ (SEQ ID NO: 5040), LNQQ (SEQ ID NO: 5041), QRKL (SEQ ID NO: 5042), LRRQ (SEQ ID NO: 5043), QRLR (SEQ ID NO: 5044), QRRL (SEQ ID NO: 5045), RRLQ (SEQ ID NO: 5046), RLRQ (SEQ ID NO: 5047), SKRQ (SEQ ID NO: 5048), QLYR (SEQ ID NO: 5049), QLTV (SEQ ID NO: 5050), QNKQ (SEQ ID NO: 5051), KNQQ (SEQ ID NO: 5052), QKQQ (SEQ ID NO: 5053), QTQQ (SEQ ID NO: 5054), QNHQ (SEQ ID NO: 5055), QHQQ (SEQ ID NO: 5056), QNQH (SEQ ID NO: 5057), QHRQ (SEQ ID NO: 5058), LTQQ (SEQ ID NO: 5059), QNQW (SEQ ID NO: 5060), QNTH (SEQ ID NO: 5061), RRRQ (SEQ ID NO: 5062), QYQQ (SEQ ID NO: 5063), QNDQ (SEQ ID NO: 5064), QNRH (SEQ ID NO: 5065), RDQQ (SEQ ID NO: 5066), PNLQ (SEQ ID NO: 5067), HVRQ (SEQ ID NO: 5068), PNQH (SEQ ID NO: 5069), HNQQ (SEQ ID NO: 5070), QSQQ (SEQ ID NO: 5071), QPAK (SEQ ID NO: 5072), QNLA (SEQ ID NO: 5073), QNQL (SEQ ID NO: 5074), QGQQ (SEQ ID NO: 5075), LNRQ (SEQ ID NO: 5076), QNPP (SEQ ID NO: 5077), QNLQ (SEQ ID NO: 5078), QDQE (SEQ ID NO: 5079), QDQQ (SEQ ID NO: 5080), HWQQ (SEQ ID NO: 5081), PNQQ (SEQ ID NO: 5082), PEQQ (SEQ ID NO: 5083), QRTM (SEQ ID NO: 5084), LHQH (SEQ ID NO: 5085), QHRI (SEQ ID NO: 5086), QYIH (SEQ ID NO: 5087), QKFE (SEQ ID NO: 5088), QFPS (SEQ ID NO: 5089), QNPL (SEQ ID NO: 5090), QAIK (SEQ ID NO: 5091), QNRQ (SEQ ID NO: 5092), QYQH (SEQ ID NO: 5093), QNPQ (SEQ ID NO: 5094), QHQL (SEQ ID NO: 5095), QSPP (SEQ ID NO: 5096), QAKL (SEQ ID NO: 5097), KSQQ (SEQ ID NO: 5098), QDRP (SEQ ID NO: 5099), QNLG (SEQ ID NO: 5100), QAFH (SEQ ID NO: 5101), QNAQ (SEQ ID NO: 5102), HNQL (SEQ ID NO: 5103), QKLN (SEQ ID NO: 5104), QNVQ (SEQ ID NO: 5105), QAQQ (SEQ ID NO: 5106), QTPP (SEQ ID NO: 5107), QPPA (SEQ ID NO: 5108), QERP (SEQ ID NO: 5109), QDLQ (SEQ ID NO: 5110), QAMH (SEQ ID NO: 5111), QHPS (SEQ ID NO: 5112), PGLQ (SEQ ID NO: 5113), QGIR (SEQ ID NO: 5114), QAPA (SEQ ID NO: 5115), QIPP (SEQ ID NO: 5116), QTQL (SEQ ID NO: 5117), QAPS (SEQ ID NO: 5118), QNTY (SEQ ID NO: 5119), QDKQ (SEQ ID NO: 5120), QNHL (SEQ ID NO: 5121), QIGM (SEQ ID NO: 5122), LNKQ (SEQ ID NO: 5123), PNQL (SEQ ID NO: 5124), QLQQ (SEQ ID NO: 5125), QRMS (SEQ ID NO: 5126), QGIL (SEQ ID NO: 5127), QDRQ (SEQ ID NO: 5128), RDWQ (SEQ ID NO: 5129), QERS (SEQ ID NO: 5130), QNYQ (SEQ ID NO: 5131), QRTC (SEQ ID NO: 5132), QIGH (SEQ ID NO: 5133), QGAI (SEQ ID NO: 5134), QVPP (SEQ ID NO: 5135), QVQQ (SEQ ID NO: 5136), LMRQ (SEQ ID NO: 5137), QYSV (SEQ ID NO: 5138), QAIT (SEQ ID NO: 5139), QKTL (SEQ ID NO: 5140), QLHH (SEQ ID NO: 5141), QNII (SEQ ID NO: 5142), QGHH (SEQ ID NO: 5143), QSKV (SEQ ID NO: 5144), QLPS (SEQ ID NO: 5145), IGKQ (SEQ ID NO: 5146), QAIH (SEQ ID NO: 5147), QHGL (SEQ ID NO: 5148), QFMC (SEQ ID NO: 5149), QNQM (SEQ ID NO: 5150), QHLQ (SEQ ID NO: 5151), QPAR (SEQ ID NO: 5152), QSLQ (SEQ ID NO: 5153), QSQL (SEQ ID NO: 5154), HSQQ (SEQ ID NO: 5155), QMPS (SEQ ID NO: 5156), QGSL (SEQ ID NO: 5157), QVPA (SEQ ID NO: 5158), HYQQ (SEQ ID NO: 5159), QVPS (SEQ ID NO: 5160), RGEQ (SEQ ID NO: 5161), PGQQ (SEQ ID NO: 5162), LEQQ (SEQ ID NO: 5163), QNQS (SEQ ID NO: 5164), QKVI (SEQ ID NO: 5165), QNND (SEQ ID NO: 5166), QSVH (SEQ ID NO: 5167), QPLG (SEQ ID NO: 5168), HNQE (SEQ ID NO: 5169), QIQQ (SEQ ID NO: 5170), QVRN (SEQ ID NO: 5171), PSNQ (SEQ ID NO: 5172), QVGH (SEQ ID NO: 5173), QRDI (SEQ ID NO: 5174), QMPN (SEQ ID NO: 5175), RGLQ (SEQ ID NO: 5176), PSLQ (SEQ ID NO: 5177), QRDQ (SEQ ID NO: 5178), QAKG (SEQ ID NO: 5179), QSAH (SEQ ID NO: 5180), QSTM (SEQ ID NO: 5181), QREM (SEQ ID NO: 5182), QYRA (SEQ ID NO: 5183), QRQQ (SEQ ID NO: 5184), QWQQ (SEQ ID NO: 5185), QRMN (SEQ ID NO: 5186), GDSQ (SEQ ID NO: 5187), QKIS (SEQ ID NO: 5188), PSMQ (SEQ ID NO: 5189), SPRQ (SEQ ID NO: 5190), MEQQ (SEQ ID NO: 5191), QYQN (SEQ ID NO: 5192), QIRQ (SEQ ID NO: 5193), QSVQ (SEQ ID NO: 5194), RSQQ (SEQ ID NO: 5195), QNKL (SEQ ID NO: 5196), QIQH (SEQ ID NO: 5197), PRQQ (SEQ ID NO: 5198), HTQQ (SEQ ID NO: 5199), QRQH (SEQ ID NO: 5200), RNQE (SEQ ID NO: 5201), QSKQ (SEQ ID NO: 5202), QNQP (SEQ ID NO: 5203), QSPQ (SEQ ID NO: 5204), QTRQ (SEQ ID NO: 5205), QNLH (SEQ ID NO: 5206), QNQE (SEQ ID NO: 5207), LNQP (SEQ ID NO: 5208), QNQD (SEQ ID NO: 5209), QNLL (SEQ ID NO: 5210), QLVI (SEQ ID NO: 5211), RTQE (SEQ ID NO: 5212), QTHQ (SEQ ID NO: 5213), QDQH (SEQ ID NO: 5214), QSQH (SEQ ID NO: 5215), VRQQ (SEQ ID NO: 5216), AWQQ (SEQ ID NO: 5217), QSVP (SEQ ID NO: 5218), QNIQ (SEQ ID NO: 5219), LDQQ (SEQ ID NO: 5220), PDQQ (SEQ ID NO: 5221), ESQQ (SEQ ID NO: 5222), QRQL (SEQ ID NO: 5223), QIIV (SEQ ID NO: 5224), QKQS (SEQ ID NO: 5225), QSHQ (SEQ ID NO: 5226), QFVV (SEQ ID NO: 5227), QSQP (SEQ ID NO: 5228), QNEQ (SEQ ID NO: 5229), INQQ (SEQ ID NO: 5230), RNRQ (SEQ ID NO: 5231), RDQK (SEQ ID NO: 5232), QWKR (SEQ ID NO: 5233), ENRQ (SEQ ID NO: 5234), QTQP (SEQ ID NO: 5235), QKQL (SEQ ID NO: 5236), RNQL (SEQ ID NO: 5237), ISIQ (SEQ ID NO: 5238), QTVC (SEQ ID NO: 5239), QQIM (SEQ ID NO: 5240), LNHQ (SEQ ID NO: 5241), QNQA (SEQ ID NO: 5242), QMIH (SEQ ID NO: 5243), RNHQ (SEQ ID NO: 5244), or QKMN (SEQ ID NO: 5245), or any dipeptide or tripeptide thereof. In some embodiments, [N1]-[N2]-[N3]-[N4] is or comprises: the amino acid sequence of any of SEQ ID NOs: 1800-2241; an amino acid sequence comprising any portion of any of the aforesaid amino acid sequences (e.g., any 2, 3, 4, 5, 6, 7, 8, 9, 10, 11, or 12 amino acids, e.g., consecutive amino acids) thereof; an amino acid sequence comprising one, two, or three but no more than four modifications, e.g., substitutions (e.g., conservative substitutions), insertions, or deletions, relative to any of the aforesaid amino acid sequences; or an amino acid sequence comprising one, two, or three but no more than four different amino acids, relative to any one of the aforesaid amino acid sequences. In some embodiments, [N1]-[N2]-[N3]-[N4] is or comprises GSGSPHSKAQNQQ (SEQ ID NO: 1801). In some embodiments, [N1]-[N2]-[N3]-[N4] is or comprises GHDSPHKSGQNQQ (SEQ ID NO: 1800).

In some embodiments, the peptide comprising an amino acid sequence having the formula [N1]-[N2]-[N3], further comprises [N0], which comprises XA XB and XC. In some embodiments, XA of [N0] is T, S, Y, M, A, C, I, R, L, D, F, V, Q, N, H, E, or G. In some embodiments, XB of [N0] is I, M, P, E, N, D, S, A, T, G, Q, F, V, L, C, H, R, W, or L. In some embodiments, XC of [N0] is N, M, E, G, Y, W, T, I, Q, F, V, A, L, I, P, K, R, H, S, D, or S. In some embodiments, [N0] is or comprises TIN, SMN, TIM, YLS, GLS, MPE, MEG, MEY, AEW, CEW, ANN, IPE, ADM, IEY, ADY, IET, MEW, CEY, RIN, MEI, LEY, ADW, IEI, DIM, FEQ, MEF, CDQ, LPE, IEN, MES, AEI, VEY, IIN, TSN, IEV, MEM, AEV, MDA, VEW, AEQ, LEW, MEL, MET, MEA, IES, MEV, CEI, ATN, MDG, QEV, ADQ, NMN, IEM, ISN, TGN, QQQ, HDW, IEG, TII, TFP, TEK, EIN, TVN, TFN, SIN, TER, TSY, ELH, AIN, SVN, TDN, TFH, TVH, TEN, TSS, TID, TCN, NIN, TEH, AEM, AIK, TDK, TFK, SDQ, TEI, NTN, TET, SIK, TEL, TEA, TAN, TIY, TFS, TES, TTN, TED, TNN, EVH, TIS, TVR, TDR, TIK, NHI, TIP, ESD, TDL, TVP, TVI, AEH, NCL, TVK, NAD, TIT, NCV, TIR, NAL, VIN, TIQ, TEF, TRE, QGE, SEK, NVN, GGE, EFV, SDK, TEQ, EVQ, TEY, NCW, TDV, SDI, NSI, NSL, EVV, TEP, SEL, TWQ, TEV, AVN, GVL, TLN, TEG, TRD, NAI, AEN, AET, ETA, NNL, or any dipeptide thereof. In some embodiments, [N0]-[N1]-[N2]-[N3]-[N4] is or comprises the amino acid sequence of any one of SEQ ID NOs: 2242-2886; an amino acid sequence comprising any portion of any of the aforesaid amino acid sequences (e.g., any 2, 3, 4, 5, 6, 7, 8, 9, 10, 11, 12, 13, 14, or 15 amino acids, e.g., consecutive amino acids) thereof; an amino acid sequence comprising one, two, or three but no more than four modifications, e.g., substitutions (e.g., conservative substitutions), insertions, or deletions, relative to any of the aforesaid amino acid sequences; or an amino acid sequence comprising one, two, or three but no more than four different amino acids, relative to any one of the aforesaid amino acid sequences. In some embodiments, [N0]-[N1]-[N2]-[N3]-[N4] is or comprises TINGSGSPHSKAQNQQ (SEQ ID NO: 2242). In some embodiments, [N0]-[N1]-[N2]-[N3]-[N4] is or comprises TINGHDSPHKSGQNQQ (SEQ ID NO: 2243).

In some embodiments, [N3] is present immediately subsequent to [N2]. In some embodiments, the peptide comprises from N-terminus to C-terminus, [N2]-[N3]. In some embodiments, the peptide comprises from N-terminus to C-terminus, [N1]-[N2]-[N3]. In some embodiments, the peptide comprises from N-terminus to C-terminus, [N1]-[N2]-[N3]-[N4]. In some embodiments, the peptide comprises from N-terminus to C-terminus, [N0]-[N1]-[N2]-[N3]. In some embodiments, the peptide comprises from N-terminus to C-terminus, [N0]-[N1]-[N2]-[N3]-[N4].

In some embodiments, the peptide comprises an amino acid sequence having the formula [A][B] (SEQ ID NO: 4694), wherein [A] comprises the amino acid sequence of GSGSPH (SEQ ID NO: 4695) and [B] comprises X1 X2 X3 X4 X5 X6 X7. In some embodiments, position X1 of [B] is S, C, F, or V. In some embodiments, position X2 of [B] is K, L, R, I, E, Y, V, or S. In some embodiments, X3 of [B] is A, R, L, G, I, Y, S, F, or W. In some embodiments X4 of [B] is W, Q, R, G, L, V, S, or F. In some embodiments, position X5 of [B] is N, Y, R, C, K, or L. In some embodiments, position X6 of [B] is Q, G, K, R, T, L, or Y. In some embodiment, position X7 of [B] is Q, L, R, or V. In some embodiments, [B] comprises S LLWNQQ (SEQ ID NO: 5247), SKAQYYV (SEQ ID NO: 5248), SKLRRQQ (SEQ ID NO: 5249), SIWQNQQ (SEQ ID NO: 5250), SKAGCGQ (SEQ ID NO: 5251), SRAQNQQ (SEQ ID NO: 5252), SKRLRQQ (SEQ ID NO: 5253), SLRRNQQ (SEQ ID NO: 5254), SRGRNQQ (SEQ ID NO: 5255), SEIVNQQ (SEQ ID NO: 5256), SSRRNQQ (SEQ ID NO: 5257), CLLQNQQ (SEQ ID NO: 5258), SKAFRLQ (SEQ ID NO: 5259), CLAQNQQ (SEQ ID NO: 5260), FLRQNQQ (SEQ ID NO: 5261), SLRFNQQ (SEQ ID NO: 5262), SYLRNQQ (SEQ ID NO: 5263), CSLQNQQ (SEQ ID NO: 5264), VLWQNQQ (SEQ ID NO: 5265), SKWLLQQ (SEQ ID NO: 5266), SLWSNQQ (SEQ ID NO: 5267), SKRRLQQ (SEQ ID NO: 5268), SVYLNQQ (SEQ ID NO: 5269), SLWLNQQ (SEQ ID NO: 5270), SKAQRKL (SEQ ID NO: 5271), SKALRRQ (SEQ ID NO: 5272), SKAQRLR (SEQ ID NO: 5273), SKAQNQQ (SEQ ID NO: 5274), SKAQRRL (SEQ ID NO: 5275), SKARRQQ (SEQ ID NO: 5276), SKARRLQ (SEQ ID NO: 5277), SKSRRQQ (SEQ ID NO: 5278), SKARLRQ (SEQ ID NO: 5279), SKASKRQ (SEQ ID NO: 5280), VRRQNQQ (SEQ ID NO: 5281), SKAQLYR (SEQ ID NO: 5282), SLFRNQQ (SEQ ID NO: 5283), SKAQLTV (SEQ ID NO: 5284), or any dipeptide, tripeptide, tetrapeptide, pentapeptide, or hexapeptide thereof. In some embodiments, [A][B] comprises GSGSPHSLLWNQQ (SEQ ID NO: 5285), GSGSPHSKAQYYV (SEQ ID NO: 2060), GSGSPHSKLRRQQ (SEQ ID NO: 2061), GSGSPHSIWQNQQ (SEQ ID NO: 5286), GSGSPHSKAGCGQ (SEQ ID NO: 2062), GSGSPHSRAQNQQ (SEQ ID NO: 2063), GSGSPHSKRLRQQ (SEQ ID NO: 2064), GSGSPHSLRRNQQ (SEQ ID NO: 2065), GSGSPHSRGRNQQ (SEQ ID NO: 2066), GSGSPHSEIVNQQ (SEQ ID NO: 5287), GSGSPHSSRRNQQ (SEQ ID NO: 2067), GSGSPHCLLQNQQ (SEQ ID NO: 5288), GSGSPHSKAFRLQ (SEQ ID NO: 2068), GSGSPHCLAQNQQ (SEQ ID NO: 5289), GSGSPHFLRQNQQ (SEQ ID NO: 2070), GSGSPHSLRFNQQ (SEQ ID NO: 2071), GSGSPHSYLRNQQ (SEQ ID NO: 5290), GSGSPHCSLQNQQ (SEQ ID NO: 5291), GSGSPHVLWQNQQ (SEQ ID NO: 5292), GSGSPHSKWLLQQ (SEQ ID NO: 2072), GSGSPHSLWSNQQ (SEQ ID NO: 5293), GSGSPHSKRRLQQ (SEQ ID NO: 2073), GSGSPHSVYLNQQ (SEQ ID NO: 5294), GSGSPHSLWLNQQ (SEQ ID NO: 5295), GSGSPHSKAQRKL (SEQ ID NO: 2074), GSGSPHSKALRRQ (SEQ ID NO: 2075), GSGSPHSKAQRLR (SEQ ID NO: 2076), GSGSPHSKAQNQQ (SEQ ID NO: 1801), GSGSPHSKAQRRL (SEQ ID NO: 2077), GSGSPHSKARRQQ (SEQ ID NO: 2078), GSGSPHSKARRLQ (SEQ ID NO: 2079), GSGSPHSKSRRQQ (SEQ ID NO: 2080), GSGSPHSKARLRQ (SEQ ID NO: 2082), GSGSPHSKASKRQ (SEQ ID NO: 2083), GSGSPHVRRQNQQ (SEQ ID NO: 2084), GSGSPHSKAQLYR (SEQ ID NO: 2085), GSGSPHSLFRNQQ (SEQ ID NO: 5296), GSGSPHSKAQLTV (SEQ ID NO: 2086), or any portion thereof, e.g., any 2, 3, 4, 5, 6, 7, 8, 9, 10, 11, or 12 amino acids, e.g., consecutive amino acids, thereof. In some embodiments, [B] is present immediately subsequent to [A]. In some embodiments, the peptide comprises from N-terminus to C-terminus, [A][B].

In some embodiments, the peptide comprises an amino acid sequence having the formula [A][B] (SEQ ID NO: 4699), wherein [A] comprises X1 X2 X3 X4 X5 X6 and [B] comprises SPHKSG (SEQ ID NO: 946). In some embodiments, position X1 of [A] is T, M, A, C, I, R, L, D, F, V, Q, N, or H. In some embodiments, position X2 of [A] is I, P, E, N, D, S, A, T, M, or Q. In some embodiments, position X3 of [A] is N, E, G, Y, W, M, T, I, K, Q, F, S, V, A, or L. In some embodiments, position X4 of [A] is G, D, R, or E. In some embodiments, position X5 of [A] is H, Q, N, or D. In some embodiments, position X6 of [A] is D or R. In some embodiments, [A] comprises TINGHD (SEQ ID NO: 5297), MPEGHD (SEQ ID NO: 5298), MEGGHD (SEQ ID NO: 5299), MEYGHD (SEQ ID NO: 5300), AEWGHD (SEQ ID NO: 5301), CEWGHD (SEQ ID NO: 5302), ANNGQD (SEQ ID NO: 5303), IPEGHD (SEQ ID NO: 5304), ADMGHD (SEQ ID NO: 5305), IEYGHD (SEQ ID NO: 5306), ADYGHD (SEQ ID NO: 5307), IETGHD (SEQ ID NO: 5308), MEWGHD (SEQ ID NO: 5309), CEYGHD (SEQ ID NO: 5310), RINGHD (SEQ ID NO: 5311), MEIGHD (SEQ ID NO: 5312), LEYGHD (SEQ ID NO: 5313), ADWGHD (SEQ ID NO: 5314), IEIGHD (SEQ ID NO: 5315), TIKDND (SEQ ID NO: 5316), DIMGHD (SEQ ID NO: 5317), FEQGHD (SEQ ID NO: 5318), MEFGHD (SEQ ID NO: 5319), CDQGHD (SEQ ID NO: 5320), LPEGHD (SEQ ID NO: 5321), IENGHD (SEQ ID NO: 5322), MESGHD (SEQ ID NO: 5323), AEIGHD (SEQ ID NO: 5324), VEYGHD (SEQ ID NO: 5325), TSNGDD (SEQ ID NO: 5326), IEVGHD (SEQ ID NO: 5327), MEMGHD (SEQ ID NO: 5328), AEVGHD (SEQ ID NO: 5329), MDAGHD (SEQ ID NO: 5330), VEWGHD (SEQ ID NO: 5331), AEQGHD (SEQ ID NO: 5332), LEWGHD (SEQ ID NO: 5333), MELGHD (SEQ ID NO: 5334), METGHD (SEQ ID NO: 5335), MEAGHD (SEQ ID NO: 5336), TINRQR (SEQ ID NO: 5337), IESGHD (SEQ ID NO: 5338), TAKDHD (SEQ ID NO: 5339), MEVGHD (SEQ ID NO: 5340), CEIGHD (SEQ ID NO: 5341), ATNGHD (SEQ ID NO: 5342), MDGGHD (SEQ ID NO: 5343), QEVGHD (SEQ ID NO: 5344), ADQGHD (SEQ ID NO: 5345), NMNGHD (SEQ ID NO: 5346), TPWEHD (SEQ ID NO: 5347), IEMGHD (SEQ ID NO: 5348), TANEHD (SEQ ID NO: 5349), QQQGHD (SEQ ID NO: 5350), TPQDHD (SEQ ID NO: 5351), HDWGHD (SEQ ID NO: 5352), IEGGHD (SEQ ID NO: 5353), or any dipeptide, tripeptide, tetrapeptide, or pentapeptide thereof. In some embodiments, [A][B] comprises TINGHDSPHKR (SEQ ID NO: 5354), MPEGHDSPHKS (SEQ ID NO: 5355), MEGGHDSPHKS (SEQ ID NO: 5356), MEYGHDSPHKS (SEQ ID NO: 5357), AEWGHDSPHKS (SEQ ID NO: 5358), CEWGHDSPHKS (SEQ ID NO: 5359), ANNGQDSPHKS (SEQ ID NO: 5360), IPEGHDSPHKS (SEQ ID NO: 5361), ADMGHDSPHKS (SEQ ID NO: 5362), IEYGHDSPHKS (SEQ ID NO: 5363), ADYGHDSPHKS (SEQ ID NO: 5364), IETGHDSPHKS (SEQ ID NO: 5365), MEWGHDSPHKS (SEQ ID NO: 5366), CEYGHDSPHKS (SEQ ID NO: 5367), RINGHDSPHKS (SEQ ID NO: 5368), MEIGHDSPHKS (SEQ ID NO: 5369), LEYGHDSPHKS (SEQ ID NO: 5370), ADWGHDSPHKS (SEQ ID NO: 5371), IEIGHDSPHKS (SEQ ID NO: 5372), TIKDNDSPHKS (SEQ ID NO: 5373), DIMGHDSPHKS (SEQ ID NO: 5374), FEQGHDSPHKS (SEQ ID NO: 5375), MEFGHDSPHKS (SEQ ID NO: 5376), CDQGHDSPHKS (SEQ ID NO: 5377), LPEGHDSPHKS (SEQ ID NO: 5378), IENGHDSPHKS (SEQ ID NO: 5379), MESGHDSPHKS (SEQ ID NO: 5380), AEIGHDSPHKS (SEQ ID NO: 5381), VEYGHDSPHKS (SEQ ID NO: 5382), TSNGDDSPHKS (SEQ ID NO: 5383), IEVGHDSPHKS (SEQ ID NO: 5384), MEMGHDSPHKS (SEQ ID NO: 5385), AEVGHDSPHKS (SEQ ID NO: 5386), MDAGHDSPHKS (SEQ ID NO: 5387), VEWGHDSPHKS (SEQ ID NO: 5388), AEQGHDSPHKS (SEQ ID NO: 5389), LEWGHDSPHKS (SEQ ID NO: 5390), MELGHDSPHKS (SEQ ID NO: 5391), METGHDSPHKS (SEQ ID NO: 5392), MEAGHDSPHKS (SEQ ID NO: 5393), TINRQRSPHKS (SEQ ID NO: 5394), IESGHDSPHKS (SEQ ID NO: 5395), TAKDHDSPHKS (SEQ ID NO: 5396), MEVGHDSPHKS (SEQ ID NO: 5397), CEIGHDSPHKS (SEQ ID NO: 5398), ATNGHDSPHKS (SEQ ID NO: 5399), MDGGHDSPHKS (SEQ ID NO: 5400), QEVGHDSPHKS (SEQ ID NO: 5401), ADQGHDSPHKS (SEQ ID NO: 5402), NMNGHDSPHKS (SEQ ID NO: 5403), TPWEHDSPHKS (SEQ ID NO: 5404), IEMGHDSPHKS (SEQ ID NO: 5405), TANEHDSPHKS (SEQ ID NO: 5406), TINGHDSPHKS (SEQ ID NO: 5407), QQQGHDSPHKS (SEQ ID NO: 5408), TPQDHDSPHKS (SEQ ID NO: 5409), HDWGHDSPHKS (SEQ ID NO: 5410), IEGGHDSPHKS (SEQ ID NO: 5411), or any portion thereof, e.g., any 2, 3, 4, 5, 6, 7, 8, 9, 10, 11, or 12 amino acids, e.g., consecutive amino acids, thereof. In some embodiments, [B] is present immediately subsequent to [A]. In some embodiments, the peptide comprises from N-terminus to C-terminus, [A][B].

In some embodiments, the peptide comprises an amino acid sequence comprising at least 3, 4, 5, 6, 7, 8, 9, 10, 11, 12, 13, 14, 15, 16, or 17 consecutive amino acids from any one of the sequences provided in Tables 1, 2A, 2B, 13-19. In some embodiments, the peptide comprises an amino acid sequence comprising at least 3, 4, or 5 consecutive amino acids from any one of SEQ ID NOs: 945-980 or 985-986. In some embodiments, the peptide comprises an amino acid sequence comprising at least 3, 4, 5, 6, 7, 8, 9, 10, 11, 12, or 13 consecutive amino acids from any one of SEQ ID NOs: 2, 200, 201, 941, 943, 204, 208, 404, or 903-909.

In some embodiments, the 3 consecutive amino acids comprise SPH. In some embodiments, the 4 consecutive amino acids comprise SPHS (SEQ ID NO: 4700). In some embodiments, the 5 consecutive amino acids comprise SPHSK (SEQ ID NO: 4701). In some embodiments, the 6 consecutive amino acids comprise SPHSKA (SEQ ID NO: 941).

In some embodiments, 3 consecutive amino acids comprise HDS. In some embodiments, the 4 consecutive amino acids comprise HDSP (SEQ ID NO: 4702). In some embodiments, the 5 consecutive amino acids comprise HDSPH (SEQ ID NO: 4703). In some embodiments, the 6 consecutive amino acids comprise HDSPHK (SEQ ID NO: 2).

In some embodiments, the 3 consecutive amino acids comprise SPH. In some embodiments, the 4 consecutive amino acids comprise SPHK (SEQ ID NO: 6398). In some embodiments, the 5 consecutive amino acids comprise SPHKY (SEQ ID NO: 4715). In some embodiments, the 6 consecutive amino acids comprise SPHKYG (SEQ ID NO: 966).

In some embodiments, the peptide comprises an amino acid sequence comprising at least one, two, or three but no more than four modifications, e.g., substitutions (e.g., conservative substitutions), insertions, or deletions, relative to the amino acid sequence of any one of the sequences provided in Tables 1, 2A, 2B, 13-19. In some embodiments, the peptide comprises an amino acid sequence comprising at least one, two, or three but no more than four different amino acids, relative to the amino acid sequence of any one of the sequences provided in Tables 1, 2A, 2B, 13-19. In some embodiments, the peptide comprises an amino acid sequence comprising at least one, two, or three but no more than four modifications, e.g., substitutions (e.g., conservative substitutions), insertions, or deletions, relative to the amino acid sequence of any one of SEQ ID NOs: 945-980 or 985-986. In some embodiments, the peptide comprises an amino acid sequence comprising at least one, two, or three but no more than four different amino acids, relative to the amino acid sequence of any one of SEQ ID NOs: 945-980 or 985-986. In some embodiments, the peptide comprises an amino acid sequence comprising at least one, two, or three but no more than four modifications, e.g., substitutions (e.g., conservative substitutions), insertions, or deletions, relative to the amino acid sequence of any one of SEQ ID NOs: 2, 200, 201, 941, 943, 204, 208, 404, or 903-909. In some embodiments, the peptide comprises an amino acid sequence comprising at least one, two, or three but no more than four different amino acids relative to the amino acid sequence of any one of SEQ ID NOs: 2, 200, 201, 941, 943, 204, 208, 404, or 903-909. In some embodiments, the peptide comprises an amino acid sequence comprising at least one, two, or three but no more than four modifications, e.g., substitutions (e.g., conservative substitutions), insertions, or deletions, relative to the amino acid sequence of SEQ ID NO: 3589. In some embodiments, the peptide comprises an amino acid sequence comprising at least one, two, or three but no more than four different amino acids relative to the amino acid sequence of SEQ ID NO: 3589. In some embodiments, the peptide comprises an amino acid sequence comprising at least one, two, or three but no more than four modifications, e.g., substitutions (e.g., conservative substitutions), insertions, or deletions, relative to the amino acid sequence of SEQ ID NO: 1754. In some embodiments, the peptide comprises an amino acid sequence comprising at least one, two, or three but no more than four different amino acids relative to the amino acid sequence of SEQ ID NO: 1754.

In some embodiments, the peptide comprises an amino acid sequence comprising at least one, two, or three but no more than four modifications, e.g., substitutions (e.g., conservative substitutions), insertions, or deletions, relative to the amino acid sequence of SPHSKA (SEQ ID NO: 941). In some embodiments, the peptide comprises an amino acid sequence comprising at least one, two, or three but no more than four different amino acids relative to the amino acid sequence of SPHSKA (SEQ ID NO: 941).

In some embodiments, the peptide comprises an amino acid sequence comprising at least one, two, or three but no more than four modifications, e.g., substitutions (e.g., conservative substitutions), insertions, or deletions, relative to the amino acid sequence of HDSPHK (SEQ ID NO: 2). In some embodiments, the peptide comprises an amino acid sequence comprising at least one, two, or three but no more than four different amino acids relative to the amino acid sequence of HDSPHK (SEQ ID NO: 2).

In some embodiments, the peptide comprises an amino acid sequence comprising at least one, two, or three but no more than four modifications, e.g., substitutions (e.g., conservative substitutions), insertions, or deletions, relative to the amino acid sequence of SPHKYG (SEQ ID NO: 966). In some embodiments, the peptide comprises an amino acid sequence comprising at least one, two, or three but no more than four different amino acids relative to the amino acid sequence of SPHKYG (SEQ ID NO: 966).

In some embodiments, the peptide comprises the amino acid sequence of any of the sequences provided in Tables 1, 2A, 2B, 13-19. In some embodiments, the peptide comprises the amino acid sequence of any of SEQ ID NOs: 945-980 or 985-986. In some embodiments, the peptide comprises the amino acid sequence of any of SEQ ID NOs: 2, 200, 201, 941, 943, 204, 208, 404, or 903-909. In some embodiments, the peptide comprises the amino acid sequence of SEQ ID NO: 941. In some embodiments, the peptide comprises the amino acid sequence of SEQ ID NO: 943. In some embodiments, the peptide comprises the amino acid sequence of SEQ ID NO: 2. In some embodiments, the peptide comprises the amino acid sequence of SEQ ID NO: 3589. In some embodiments, the peptide comprises the amino acid sequence of SEQ ID NO: 1754. In some embodiments, the peptide comprises the amino acid sequence of SEQ ID NO: 3241. In some embodiments, the peptide comprises the amino acid sequence of SEQ ID NO: 4100. In some embodiments, the peptide comprises the amino acid sequence of SEQ ID NO: 4062. In some embodiments, the peptide comprises the amino acid sequence of SEQ ID NO: 4486.

In some embodiments, the peptide comprises an amino acid sequence encoded by a nucleotide sequence described herein, e.g., a nucleotide sequence of Table 2A. In some embodiments, the peptide comprises an amino acid sequence encoded by a nucleotide sequence comprising at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 942. In some embodiments, the peptide comprises an amino acid sequence encoded by a nucleotide sequence comprising at least one, two, three, four, five, six, or seven, but no more than ten different nucleotides, relative to the nucleotide sequence of SEQ ID NO: 942. In some embodiments, the peptide comprises an amino acid sequence encoded by the nucleotide sequence of SEQ ID NO: 942, or a nucleotide sequence substantially identical (e.g., having at least 70%, 75%, 80%, 85%, 90%, 92%, 95%, 97%, 98%, or 99% sequence identity) thereto. In some embodiments, the peptide comprises an amino acid sequence encoded by a nucleotide sequence comprising at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 944. In some embodiments, the peptide comprises an amino acid sequence encoded by a nucleotide sequence comprising at least one, two, three, four, five, six, or seven, but no more than ten different nucleotides, relative to the nucleotide sequence of SEQ ID NO: 944. In some embodiments, the peptide comprises an amino acid sequence encoded by the nucleotide sequence of SEQ ID NO: 944, or a nucleotide sequence substantially identical (e.g., having at least 70%, 75%, 80%, 85%, 90%, 92%, 95%, 97%, 98%, or 99% sequence identity) thereto.

In some embodiments, the nucleotide sequence encoding a peptide described herein comprises a nucleotide sequence described herein, e.g., as described in Table 2A. In some embodiments, the nucleotide sequence encoding a peptide described herein is codon optimized. In some embodiments, the nucleotide sequence encoding a peptide described herein is isolated, e.g., recombinant.

In some embodiments the nucleotide sequence encoding a peptide described herein comprises the nucleotide sequence of SEQ ID NO: 942, or a nucleotide sequence comprising at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 942. In some embodiments, the nucleotide sequence encoding a peptide described herein comprises a nucleotide sequence comprising at least one, two, three, four, five, six, or seven, but no more than ten different nucleotides, relative to the nucleotide sequence of SEQ ID NO: 942. In some embodiments the nucleic acid sequence encoding a peptide described herein comprises a nucleotide sequence comprising the nucleotide sequence of SEQ ID NO: 942, or a nucleotide sequence substantially identical (e.g., having at least 70%, 75%, 80%, 85%, 90%, 92%, 95%, 97%, 98%, or 99% sequence identity) thereto.

In some embodiments, the nucleic acid encoding a peptide described herein comprises the nucleotide sequence of SEQ ID NO: 3, or a nucleotide sequence comprising at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 3. In some embodiments, the nucleotide sequence encoding a peptide described herein comprises a nucleotide sequence comprising at least one, two, three, four, five, six, or seven, but no more than ten different nucleotides, relative to the nucleotide sequence of SEQ ID NO: 3. In some embodiments the nucleic acid encoding a peptide described herein comprises a nucleotide sequence comprising the nucleotide sequence of SEQ ID NO: 3, or a nucleotide sequence substantially identical (e.g., having at least 70%, 75%, 80%, 85%, 90%, 92%, 95%, 97%, 98%, or 99% sequence identity) thereto.

In some embodiments, the nucleic acid encoding a peptide described herein comprises the nucleotide sequence of SEQ ID NO: 944, or a nucleotide sequence comprising at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 944. In some embodiments, the nucleotide sequence encoding a peptide described herein comprises a nucleotide sequence comprising at least one, two, three, four, five, six, or seven, but no more than ten different nucleotides, relative to the nucleotide sequence of SEQ ID NO: 944. In some embodiments the nucleic acid encoding a peptide described herein comprises a nucleotide sequence comprising the nucleotide sequence of SEQ ID NO: 944, or a nucleotide sequence substantially identical (e.g., having at least 70%, 75%, 80%, 85%, 90%, 92%, 95%, 97%, 98%, or 99% sequence identity) thereto.

In some embodiments, a peptide described herein is fused or coupled, e.g., conjugated, to an active agent. In some embodiments, the active agent is a therapeutic agent. In some embodiments, the agent is a therapeutic agent. In some embodiments, the active agent comprises a therapeutic protein, an antibody molecule, an enzyme, one or more components of a genome editing system, an Fc polypeptide fused or coupled (e.g., covalently or non covalently) to a therapeutic agent, and/or an RNAi agent (e.g., a dsRNA, antisense oligonucleotide (ASO), siRNA, shRNA, pre-miRNA, pri-miRNA, miRNA, stRNA, lncRNA, piRNA, or snoRNA). In some embodiments, the therapeutic agent is an antibody. In some embodiments, the peptide is fused or coupled, e.g., conjugated (e.g., directly or indirectly) to the Fc region of the antibody, e.g., at the C-terminus of the Fc region or the N-terminus of the Fc region. In some embodiments, the therapeutic agent is an RNAi agent. In some embodiments, the RNAi agent is a siRNA or an ASO. In some embodiments, the ASO or siRNA comprises at least one (e.g., one or more or all) modified nucleotides. In some embodiments, the peptide is fused or coupled, e.g., conjugated (e.g., directly or indirectly via a linker), to at least one strand of the RNAi agent. In some embodiments, the peptide is conjugated, e.g., directly or indirectly via a linker, to the C-terminus of at least one strand of the RNAi agent. In some embodiments, the peptide is conjugated, e.g., directly or indirectly via a linker, to an internal nucleotide of at least one strand of the RNAi agent. In some embodiments, the at least one strand is the sense strand. In some embodiments, the therapeutic agent modulates, e.g., inhibits, decreases, or increases, expression of, a CNS related gene, mRNA, and/or protein.

In some embodiments, the active agent is a diagnostic agent. In some embodiments, the diagnostic agent is or comprises an imaging agent (e.g., a protein or small molecule compound coupled to a detectable moiety). In some embodiments, the imaging agent comprises a PET or MRI ligand, or an antibody molecule coupled to a detectable moiety. In some embodiments, the detectable moiety is or comprises a radiolabel, a fluorophore, a chromophore, or an affinity tag. In some embodiments, the radiolabel is or comprises tc99m, iodine-123, a spin label, iodine-131, indium-111, fluorine-19, carbon-13, nitrogen-15, oxygen-17, gadolinium, manganese, or iron. In some embodiments, the active agent is a small molecule. In some embodiments, the active agent is a ribonucleic acid complex (e.g., a Cas9/gRNA complex), a plasmid, a closed-end DNA, a circ-RNA, or an mRNA.

In some embodiments, at least 1-5, e.g., at least 1, 2, 3, 4, or 5, peptides are fused or coupled, e.g., conjugated, to an active agent, e.g., a therapeutic agent or a diagnostic agent. In some embodiments, the at least 1-5, e.g., at least 1, 2, 3, 4, or 5, peptides comprise the same amino acid sequence. In some embodiments, the at least 1-5, e.g., at least 1, 2, 3, 4, or 5, peptides comprise different amino acid sequences. In some embodiments, the at least 1-5, e.g., at least 1, 2, 3, 4, or 5, peptides are present in tandem (e.g., connected directly or indirectly via a linker) or in a multimeric configuration. In some embodiments, the peptide comprises an amino acid sequence of at least 3, 4, 5, 6, 7, 8, 9, 10, 11, 12, 15, 20, 25, 30, or 35 amino acids in length.

In some embodiments, the peptide covalently linked, e.g., directly or indirectly via a linker, to the active agent. In some embodiments, the peptide is conjugated to the active agent via a linker. In some embodiments, the linker is a cleavable linker or a non-cleavable linker. In some embodiments, the cleavable linker is a pH sensitive linker or an enzyme sensitive linker. In some embodiments, the pH sensitive linker comprises a hydrazine/hydrazone linker or a disulfide linker. In some embodiments, the enzyme sensitive linker comprises a peptide based linker, e.g., a peptide linker sensitive to a protease (e.g., a lysosomal protease); or a beta-glucuronide linker. In some embodiments, the non-cleavable linker is a linker comprising a thioether group or a maleimidocaproyl group. In some embodiments, the peptide and the active agent are fused or coupled post-translationally, e.g., using click chemistry. In some embodiments, the peptide and the active agent are fused or couple via chemically induced dimerization. In some embodiments, the peptide is present N-terminal relative to the active agent. In some embodiments, the peptide is present C-terminal relative to the active agent.

In some embodiments, the peptide is present or coupled to a carrier. In some embodiments, the carrier comprises an exosome, a microvesicle, or a lipid nanoparticle (LNP). In some embodiments, the carrier comprises a therapeutic agent (e.g., an RNAi agent (e.g., an dsRNA, a siRNA, a shRNA, a pre-miRNA, a pri-miRNA, a miRNA, a stRNA, a lncRNA, a piRNA, an antisense oligonucleotide agent (ASO), or a snoRNA), an mRNA, a ribonucleoprotein complex (e.g., a Cas9/gRNA complex), or a circRNA). In some embodiments, the peptide is present on the surface of the carrier. In some embodiments, at least 10%, 20%, 30%, 40%, 50%, 60%, 70%, or 80% of the surface of the carrier comprises at least 1-5, e.g., at least 1, 2, 3, 4, or 5 peptides described herein.

The present disclosure also provides a nucleic acid or polynucleotide encoding any of the peptides described herein and AAV capsid variants, AAV particles, vectors, and cells comprising the same.

AAV Capsid Variant

In some embodiments, an AAV particle described herein comprises an AAV capsid variant, e.g., an AAV capsid variant described herein (e.g., an AAV capsid variant comprising a peptide described herein). In some embodiments, an AAV capsid variant comprises a peptide as set forth in any of Tables 1, 2A, 2B, 13-19.

In some embodiments, an AAV capsid variant described herein comprises an amino acid sequence having the formula [N1]-[N2]-[N3], wherein [N2] comprises the amino acid sequence of SPH and [N3] comprises X4, X5, and X6, wherein at least one of X4, X5, or X6 is a basic amino acid, e.g., a K or R. In some embodiments, position X4 of [N2] is K. In some embodiments, position X5 of [N2] is K.

In some embodiments, [N1] comprises X1, X2, and X3, wherein at least one of X1, X2, or X3 is G. In some embodiments, position X1 of [N1] is G, V, R, D, E, M, T, I, S, A, N, L, K, H, P, W, or C. In some embodiments, position X2 of [N1] is: S, V, L, N, D, H, R, P, G, T, I, A, E, Y, M, or Q. In some embodiments, position X3 of [N1] is: G, C, L, D, E, Y, H, V, A, N, P, or S. In some embodiments, [N1] comprises GS, SG, GH, HD, GQ, QD, VS, CS, GR, RG, QS, SH, MS, RN, TS, IS, GP, ES, SS, GN, AS, NS, LS, GG, KS, GT, PS, RS, GI, WS, DS, ID, GL, DA, DG, ME, EN, KN, KE, AI, NG, PG, TG, SV, IG, LG, AG, EG, SA, YD, HE, HG, RD, ND, PD, MG, QV, DD, HN, HP, GY, GM, GD, or HS. In some embodiments, [N1] comprises GS, SG, GH, or HD. In some embodiments [N1] is or comprises GSG, GHD, GQD, VSG, CSG, CSH, GQS, GRG, GSH, RVG, GSC, GLL, GDD, GHE, GNY, MSG, RNG, TSG, ISG, GPG, ESG, SSG, GNG, ASG, NSG, LSG, GGG, KSG, HSG, GTG, PSG, GSV, RSG, GIG, WSG, DSG, IDG, GLG, DAG, DGG, MEG, ENG, GSA, KNG, KEG, AIG, GYD, GHG, GRD, GND, GPD, GMG, GQV, GHN, GHP, or GHS. In some embodiments, [N1] is or comprises GSG. In some embodiments, [N1] is or comprises GHD. In some embodiments, [N1]-[N2] comprises SGSPH (SEQ ID NO: 4752), HDSPH (SEQ ID NO: 4703), QDSPH (SEQ ID NO: 4753), RGSPH (SEQ ID NO: 4754), SHSPH (SEQ ID NO: 4755), QSSPH (SEQ ID NO: 4756), DDSPH (SEQ ID NO: 4757), HESPH (SEQ ID NO: 4758), NYSPH (SEQ ID NO: 4759), VGSPH (SEQ ID NO: 4760), SCSPH (SEQ ID NO: 4761), LLSPH (SEQ ID NO: 4762), NGSPH (SEQ ID NO: 4763), PGSPH (SEQ ID NO: 4764), GGSPH (SEQ ID NO: 4765), TGSPH (SEQ ID NO: 4766), SVSPH (SEQ ID NO: 4767), IGSPH (SEQ ID NO: 4768), DGSPH (SEQ ID NO: 4769), LGSPH (SEQ ID NO: 4770), AGSPH (SEQ ID NO: 4771), EGSPH (SEQ ID NO: 4772), SASPH (SEQ ID NO: 4773), YDSPH (SEQ ID NO: 4774), HGSPH (SEQ ID NO: 4775), RDSPH (SEQ ID NO: 4776), NDSPH (SEQ ID NO: 4777), PDSPH (SEQ ID NO: 4778), MGSPH (SEQ ID NO: 4779), QVSPH (SEQ ID NO: 4780), HNSPH (SEQ ID NO: 4781), HPSPH (SEQ ID NO: 4782), or HSSPH (SEQ ID NO: 4783); an amino acid sequence comprising any portion of any of the aforesaid amino acid sequences (e.g., any 2, 3, or 4 amino acids, e.g., consecutive amino acids) thereof; an amino acid sequence comprising one, two, or three but no more than four modifications, e.g., substitutions (e.g., conservative substitutions), insertions, or deletions, relative to any of the aforesaid amino acid sequences; or an amino acid sequence comprising one, two, or three but no more than four different amino acids, relative to any one of the aforesaid amino acid sequences. In some embodiments, [N1]-[N2] is or comprises GSGSPH (SEQ ID NO: 4695), GHDSPH (SEQ ID NO: 4784), GQDSPH (SEQ ID NO: 4785), VSGSPH (SEQ ID NO: 4786), CSGSPH (SEQ ID NO: 4787), GRGSPH (SEQ ID NO: 4788), CSHSPH (SEQ ID NO: 4789), GQSSPH (SEQ ID NO: 4790), GSHSPH (SEQ ID NO: 4791), GDDSPH (SEQ ID NO: 4792), GHESPH (SEQ ID NO: 4793), GNYSPH (SEQ ID NO: 4794), RVGSPH (SEQ ID NO: 4795), GSCSPH (SEQ ID NO: 4796), GLLSPH (SEQ ID NO: 4797), MSGSPH (SEQ ID NO: 4798), RNGSPH (SEQ ID NO: 4799), TSGSPH (SEQ ID NO: 4800), ISGSPH (SEQ ID NO: 4801), GPGSPH (SEQ ID NO: 4802), ESGSPH (SEQ ID NO: 4803), SSGSPH (SEQ ID NO: 4804), GNGSPH (SEQ ID NO: 4805), ASGSPH (SEQ ID NO: 4806), NSGSPH (SEQ ID NO: 4807), LSGSPH (SEQ ID NO: 4808), GGGSPH (SEQ ID NO: 4809), KSGSPH (SEQ ID NO: 4810), HSGSPH (SEQ ID NO: 4811), GTGSPH (SEQ ID NO: 4812), PSGSPH (SEQ ID NO: 4813), GSVSPH (SEQ ID NO: 4814), RSGSPH (SEQ ID NO: 4815), GIGSPH (SEQ ID NO: 4816), WSGSPH (SEQ ID NO: 4817), DSGSPH (SEQ ID NO: 4818), IDGSPH (SEQ ID NO: 4819), GLGSPH (SEQ ID NO: 4820), DAGSPH (SEQ ID NO: 4821), DGGSPH (SEQ ID NO: 4822), MEGSPH (SEQ ID NO: 4823), ENGSPH (SEQ ID NO: 4824), GSASPH (SEQ ID NO: 4825), KNGSPH (SEQ ID NO: 4826), KEGSPH (SEQ ID NO: 4827), AIGSPH (SEQ ID NO: 4828), GYDSPH (SEQ ID NO: 4829), GHGSPH (SEQ ID NO: 4830), GRDSPH (SEQ ID NO: 4831), GNDSPH (SEQ ID NO: 4832), GPDSPH (SEQ ID NO: 4833), GMGSPH (SEQ ID NO: 4834), GQVSPH (SEQ ID NO: 4835), GHNSPH (SEQ ID NO: 4836), GHPSPH (SEQ ID NO: 4837), or GHSSPH (SEQ ID NO: 4838); an amino acid sequence comprising any portion of any of the aforesaid amino acid sequences (e.g., any 2, 3, 4, or 5 amino acids, e.g., consecutive amino acids) thereof; an amino acid sequence comprising one, two, or three but no more than four modifications, e.g., substitutions (e.g., conservative substitutions), insertions, or deletions, relative to any of the aforesaid amino acid sequences; or an amino acid sequence comprising one, two, or three but no more than four different amino acids, relative to any one of the aforesaid amino acid sequences. In some embodiments, [N1]-[N2] is or comprises GSGSPH (SEQ ID NO: 4695). In some embodiments, [N1]-[N2] is or comprises GHDSPH (SEQ ID NO: 4784).

In some embodiments, X4, X5, or both of [N3] are K. In some embodiments, X4, X5, or X6 of [N3] is R. In some embodiments, position X4 of [N3] is: A, K, V, S, T, G, F, W, V, N, or R. In some embodiments, position X5 of [N3] is: S, K, T, F, I, L, Y, H, M, or R. In some embodiments, position X6 of [N3] is: G, R, A, M, I, N, T, Y, D, P, V, L, E, W, N, Q, K, or S. In some embodiments, [N3] comprises SK, KA, KS, AR, RM, VK, AS, SR, VK, KR, KK, KN, VR, RS, RK, KT, TS, KF, FG, KI, IG, KL, LG, TT, TY, KY, YG, KD, KP, TR, RG, VR, GA, SL, SS, FL, WK, SA, RA, LR, KW, RR, GK, TK, NK, AK, KV, KG, KH, KM, TG, SE, SV, SW, SN, HG, SQ, LW, MG, MA, or SG. In some embodiments, [N3] comprises SK, KA, KS, or SG. In some embodiments, [N3] is or comprises SKA, KSG, ARM, VKS, ASR, VKI, KKN, VRM, RKA, KTS, KFG, KIG, KLG, KTT, KTY, KYG, SKD, SKP, TRG, VRG, KRG, GAR, KSA, KSR, SKL, SRA, SKR, SLR, SRG, SSR, FLR, SKW, SKS, WKA, VRR, SKV, SKT, SKG, GKA, TKA, NKA, SKL, SKN, AKA, KTG, KSL, KSE, KSV, KSW, KSN, KHG, KSQ, KSK, KLW, WKG, KMG, KMA, or RSG. In some embodiments, [N3] is or comprises SKA. In some embodiments, [N3] is or comprises KSG. In some embodiments, [N2]-[N3] comprises SPHSK (SEQ ID NO: 4701), SPHKS (SEQ ID NO: 4704), SPHAR (SEQ ID NO: 4705), SPHVK (SEQ ID NO: 4706), SPHAS (SEQ ID NO: 4707), SPHKK (SEQ ID NO: 4708), SPHVR (SEQ ID NO: 4709), SPHRK (SEQ ID NO: 4710), SPHKT (SEQ ID NO: 4711), SPHKF (SEQ ID NO: 4712), SPHKI (SEQ ID NO: 4713), SPHKL (SEQ ID NO: 4714), SPHKY (SEQ ID NO: 4715), SPHTR (SEQ ID NO: 4716), SPHKR (SEQ ID NO: 4717), SPHGA (SEQ ID NO: 4718), SPHSR (SEQ ID NO: 4719), SPHSL (SEQ ID NO:

4720), SPHSS (SEQ ID NO: 4721), SPHFL (SEQ ID NO: 4722), SPHWK (SEQ ID NO: 4723), SPHGK (SEQ ID NO: 4724), SPHTK (SEQ ID NO: 4725), SPHNK (SEQ ID NO: 4726), SPHAK (SEQ ID NO: 4727), SPHKH (SEQ ID NO: 4728), SPHKM (SEQ ID NO: 4729), or SPHRS (SEQ ID NO: 4730). In some embodiments [N2]-[N3] comprises SPHSK (SEQ ID NO: 4701) or SPHKS (SEQ ID NO: 4704). In some embodiments, [N2]-[N3] is or comprises SPHSKA (SEQ ID NO: 941), SPHKSG (SEQ ID NO: 946), SPHARM (SEQ ID NO: 947), SPHVKS (SEQ ID NO: 948), SPHASR (SEQ ID NO: 949), SPHVKI (SEQ ID NO: 950), SPHKKN (SEQ ID NO: 954), SPHVRM (SEQ ID NO: 955), SPHRKA (SEQ ID NO: 956), SPHKFG (SEQ ID NO: 957), SPHKIG (SEQ ID NO: 958), SPHKLG (SEQ ID NO: 959), SPHKTS (SEQ ID NO: 963), SPHKTT (SEQ ID NO: 964), SPHKTY (SEQ ID NO: 965), SPHKYG (SEQ ID NO: 966), SPHSKD (SEQ ID NO: 967), SPHSKP (SEQ ID NO: 968), SPHTRG (SEQ ID NO: 972), SPHVRG (SEQ ID NO: 973), SPHKRG (SEQ ID NO: 974), SPHGAR (SEQ ID NO: 975), SPHKSA (SEQ ID NO: 977), SPHKSR (SEQ ID NO: 951), SPHSKL (SEQ ID NO: 960), SPHSRA (SEQ ID NO: 969), SPHSKR (SEQ ID NO: 978), SPHSLR (SEQ ID NO: 952), SPHSRG (SEQ ID NO: 961), SPHSSR (SEQ ID NO: 970), SPHFLR (SEQ ID NO: 979), SPHSKW (SEQ ID NO: 953), SPHSKS (SEQ ID NO: 962), SPHWKA (SEQ ID NO: 971), SPHVRR (SEQ ID NO: 980), SPHSKT (SEQ ID NO: 4731), SPHSKG (SEQ ID NO: 4732), SPHGKA (SEQ ID NO: 4733), SPHNKA (SEQ ID NO: 4734), SPHSKN (SEQ ID NO: 4735), SPHAKA (SEQ ID NO: 4736), SPHSKV (SEQ ID NO: 4737), SPHKTG (SEQ ID NO: 4738), SPHTKA (SEQ ID NO: 4739), SPHKSL (SEQ ID NO: 4740), SPHKSE (SEQ ID NO: 4741), SPHKSV (SEQ ID NO: 4742), SPHKSW (SEQ ID NO: 4743), SPHKSN (SEQ ID NO: 4744), SPHKHG (SEQ ID NO: 4745), SPHKSQ (SEQ ID NO: 4746), SPHKSK (SEQ ID NO: 4747), SPHKLW (SEQ ID NO: 4748), SPHWKG (SEQ ID NO: 4749), SPHKMG (SEQ ID NO: 4750), SPHKMA (SEQ ID NO: 4751), or SPHRSG (SEQ ID NO: 976). In some embodiments, [N2]-[N3] is SPHSKA (SEQ ID NO: 941). In some embodiments, [N2]-[N3] is or comprises SPHKSG (SEQ ID NO: 946).

In some embodiments, [N1]-[N2]-[N3] comprises SGPHSK (SEQ ID NO: 4839), HDSPHKS (SEQ ID NO: 4840), SGSPHAR (SEQ ID NO: 4841), SGSPHVK (SEQ ID NO: 4842), QDSPHKS (SEQ ID NO: 4843), SGSPHKK (SEQ ID NO: 4844), SGSPHVR (SEQ ID NO: 4845), SGSPHAS (SEQ ID NO: 4846), SGSPHRK (SEQ ID NO: 4847), SGSPHKT (SEQ ID NO: 4848), SHSPHKS (SEQ ID NO: 4849), QSSPHRS (SEQ ID NO: 4850), RGSPHAS (SEQ ID NO: 4851), RGSPHSK (SEQ ID NO: 4852), SGSPHKF (SEQ ID NO: 4853), SGSPHKI (SEQ ID NO: 4854), SGSPHKL (SEQ ID NO: 4855), SGSPHKY (SEQ ID NO: 4856), SGSPHTR (SEQ ID NO: 4857), SHSPHKR (SEQ ID NO: 4858), SGSPHGA (SEQ ID NO: 4859), HDSPHKR (SEQ ID NO: 4860), DDSPHKS (SEQ ID NO: 4861), HESPHKS (SEQ ID NO: 4862), NYSPHKI (SEQ ID NO: 4863), SGSPHSR (SEQ ID NO: 4864), SGSPHSL (SEQ ID NO: 4865), SGSPHSS (SEQ ID NO: 4866), VGSPHSK (SEQ ID NO: 4867), SCSPHRK (SEQ ID NO: 4868), SGSPHFL (SEQ ID NO: 4869), LLSPHWK (SEQ ID NO: 4870), NGSPHSK (SEQ ID NO: 4871), PGSPHSK (SEQ ID NO: 4872), GGSPHSK (SEQ ID NO: 4873), TGSPHSK (SEQ ID NO: 4874), SVSPHGK (SEQ ID NO: 4875), SGSPHTK (SEQ ID NO: 4876), IGSPHSK (SEQ ID NO: 4877), DGSPHSK (SEQ ID NO: 4878), SGSPHNK (SEQ ID NO: 4879), LGSPHSK (SEQ ID NO: 4880), AGSPHSK (SEQ ID NO: 4881), EGSPHSK (SEQ ID NO: 4882), SASPHSK (SEQ ID NO: 4883), SGSPHAK (SEQ ID NO: 4884), HDSPHKI (SEQ ID NO: 4885), YDSPHKS (SEQ ID NO: 4886), HDSPHKT (SEQ ID NO: 4887), RGSPHKR (SEQ ID NO: 4888), HGSPHSK (SEQ ID NO: 4889), RDSPHKS (SEQ ID NO: 4890), NDSPHKS (SEQ ID NO: 4891), QDSPHKI (SEQ ID NO: 4892), PDSPHKI (SEQ ID NO: 4893), PDSPHKS (SEQ ID NO: 4894), MGSPHSK (SEQ ID NO: 4895), HDSPHKH (SEQ ID NO: 4896), QVSPHKS (SEQ ID NO: 4897), HNSPHKS (SEQ ID NO: 4898), NGSPHKR (SEQ ID NO: 4899), HDSPHKY (SEQ ID NO: 4900), NDSPHKI (SEQ ID NO: 4901), HDSPHKL (SEQ ID NO: 4902), HPSPHWK (SEQ ID NO: 4903), HDSPHKM (SEQ ID NO: 4904), or HSSPHRS (SEQ ID NO: 4905). In some embodiments, [N1]-[N2]-[N3] is GSGSPHSKA (SEQ ID NO: 4697), GHDSPHKSG (SEQ ID NO: 4698), GSGSPHARM (SEQ ID NO: 4906), GSGSPHVKS (SEQ ID NO: 4907), GQDSPHKSG (SEQ ID NO: 4908), GSGSPHASR (SEQ ID NO: 4909), GSGSPHVKI (SEQ ID NO: 4910), GSGSPHKKN (SEQ ID NO: 4911), GSGSPHVRM (SEQ ID NO: 4912), VSGSPHSKA (SEQ ID NO: 4913), CSGSPHSKA (SEQ ID NO: 4914), GSGSPHRKA (SEQ ID NO: 4915), CSGSPHKTS (SEQ ID NO: 4916), CSHSPHKSG (SEQ ID NO: 4917), GQSSPHRSG (SEQ ID NO: 4918), GRGSPHASR (SEQ ID NO: 4919), GRGSPHSKA (SEQ ID NO: 4920), GSGSPHKFG (SEQ ID NO: 4921), GSGSPHKIG (SEQ ID NO: 4922), GSGSPHKLG (SEQ ID NO: 4923), GSGSPHKTS (SEQ ID NO: 4924), GSGSPHKTT (SEQ ID NO: 4925), GSGSPHKTY (SEQ ID NO: 4926), GSGSPHKYG (SEQ ID NO: 4927), GSGSPHSKD (SEQ ID NO: 4928), GSGSPHSKP (SEQ ID NO: 4929), GSGSPHTRG (SEQ ID NO: 4930), GSGSPHVRG (SEQ ID NO: 4931), GSHSPHKRG (SEQ ID NO: 4932), GSHSPHKSG (SEQ ID NO: 4933), VSGSPHASR (SEQ ID NO: 4934), VSGSPHGAR (SEQ ID NO: 4935), VSGSPHKFG (SEQ ID NO: 4936), GHDSPHKRG (SEQ ID NO: 4937), GDDSPHKSG (SEQ ID NO: 4938), GHESPHKSA (SEQ ID NO: 4939), GHDSPHKSA (SEQ ID NO: 4940), GNYSPHKIG (SEQ ID NO: 4941), GHDSPHKSR (SEQ ID NO: 4942), GSGSPHSKL (SEQ ID NO: 4943), GSGSPHSRA (SEQ ID NO: 4944), GSGSPHSKR (SEQ ID NO: 4945), GSGSPHSLR (SEQ ID NO: 4946), GSGSPHSRG (SEQ ID NO: 4947), GSGSPHSSR (SEQ ID NO: 4948), RVGSPHSKA (SEQ ID NO: 4949), GSCSPHRKA (SEQ ID NO: 4950), GSGSPHFLR (SEQ ID NO: 4951), GSGSPHSKW (SEQ ID NO: 4952), GSGSPHSKS (SEQ ID NO: 4953), GLLSPHWKA (SEQ ID NO: 4954), GSGSPHVRR (SEQ ID NO: 4955), GSGSPHSKV (SEQ ID NO: 4956), MSGSPHSKA (SEQ ID NO: 4957), RNGSPHSKA (SEQ ID NO: 4958), TSGSPHSKA (SEQ ID NO: 4959), ISGSPHSKA (SEQ ID NO: 4960), GPGSPHSKA (SEQ ID NO: 4961), GSGSPHSKT (SEQ ID NO: 4962), ESGSPHSKA (SEQ ID NO: 4963), SSGSPHSKA (SEQ ID NO: 4964), GNGSPHSKA (SEQ ID NO: 4965), ASGSPHSKA (SEQ ID NO: 4966), NSGSPHSKA (SEQ ID NO: 4967), LSGSPHSKA (SEQ ID NO: 4968), GGGSPHSKA (SEQ ID NO: 4969), KSGSPHSKA (SEQ ID NO: 4970), GGGSPHSKS (SEQ ID NO: 4971), GSGSPHSKG (SEQ ID NO: 4972), HSGSPHSKA (SEQ ID NO: 4973), GTGSPHSKA (SEQ ID NO: 4974), PSGSPHSKA (SEQ ID NO: 4975), GSVSPHGKA (SEQ ID NO: 4976), RSGSPHSKA (SEQ ID NO: 4977), GSGSPHTKA (SEQ ID NO: 4978), GIGSPHSKA (SEQ ID NO: 4979), WSGSPHSKA (SEQ ID NO: 4980), DSGSPHSKA (SEQ ID NO: 4981), IDGSPHSKA (SEQ ID NO: 4982), GSGSPHNKA (SEQ ID NO: 4983), GLGSPHSKS (SEQ ID NO: 4984), DAGSPHSKA (SEQ ID NO: 4985), DGGSPHSKA (SEQ ID NO: 4986), MEGSPHSKA (SEQ ID NO: 4987), ENGSPHSKA (SEQ ID NO: 4988), GSASPHSKA (SEQ ID NO: 4989), GNGSPHSKS (SEQ ID NO: 4990), KNGSPHSKA (SEQ ID NO: 4991), KEGSPHSKA (SEQ ID NO: 4992), AIGSPHSKA (SEQ ID NO: 4993), GSGSPHSKN (SEQ ID NO: 4994), GSGSPHAKA (SEQ ID NO: 4995), GHDSPHKIG (SEQ ID NO: 4996), GYDSPHKSG (SEQ ID NO: 4997), GHESPHKSG (SEQ ID NO: 4998), GHDSPHKTG (SEQ ID NO: 4999), GRGSPHKRG (SEQ ID NO: 5000), GQDSPHKSG (SEQ ID NO: 4908), GHDSPHKSL (SEQ ID NO: 5001), GHGSPHSKA (SEQ ID NO: 5002), GHDSPHKSE (SEQ ID NO: 5003), VSGSPHSKA (SEQ ID NO: 4913), GRDSPHKSG (SEQ ID NO: 5004), GNDSPHKSV (SEQ ID NO: 5005), GQDSPHKIG (SEQ ID NO: 5006), GHDSPHKSV (SEQ ID NO: 5007), GPDSPHKIG (SEQ ID NO: 5008), GPDSPHKSG (SEQ ID NO: 5009), GHDSPHKSW (SEQ ID NO: 5010), GHDSPHKSN (SEQ ID NO: 5011), GMGSPHSKT (SEQ ID NO: 5012), GHDSPHKHG (SEQ ID NO: 5013), GQVSPHKSG (SEQ ID NO: 5014), GDDSPHKSV (SEQ ID NO: 5015), GHNSPHKSG (SEQ ID NO: 5016), GNGSPHKRG (SEQ ID NO: 5017), GHDSPHKYG (SEQ ID NO: 5018), GHDSPHKSQ (SEQ ID NO: 5019), GNDSPHKIG (SEQ ID NO: 5020), GHDSPHKSK (SEQ ID NO: 5021), GHDSPHKLW (SEQ ID NO: 5022), GHPSPHWKG (SEQ ID NO: 5023), GHDSPHKMG (SEQ ID NO: 5024), GHDSPHKMA (SEQ ID NO: 5025), or GHSSPHRSG (SEQ ID NO: 5026); an amino acid sequence comprising any portion of any of the aforesaid amino acid sequences (e.g., any 2, 3, 4, 5, 6, 7, or 8 amino acids, e.g., consecutive amino acids) thereof; an amino acid sequence comprising one, two, or three but no more than four modifications, e.g., substitutions (e.g., conservative substitutions), insertions, or deletions, relative to any of the aforesaid amino acid sequences; or an amino acid sequence comprising one, two, or three but no more than four different amino acids, relative to any one of the aforesaid amino acid sequences. In some embodiments, [N1]-[N2]-[N3] is or comprises GSGSPHSKA (SEQ ID NO: 4697). In some embodiments, [N1]-[N2]-[N3] is or comprises GHDSPHKSG (SEQ ID NO: 4698).

In some embodiments, the AAV capsid variant comprising an amino acid sequence having the formula [N1]-[N2]-[N3], further comprises [N4], wherein [N4] comprises X7 X8 X9 X10. In some embodiments, position X7 of [N4] is W, Q, K, R, G, L, V, S, P, H, K, I, M, A, E, or F. In some embodiments, position X8 of [N4] is N, Y, C, K, T, H, R, D, V, S, P, G, W, E, F, A, I, M, Q, or L. In some embodiments, position X9 of [N4] is Q, G, K, H, R, T, L, D, A, P, I, F, V, M, W, Y, S, E, N, or Y. In some embodiments, position X10 of [N4] is Q, H, L, R, W, K, A, P, E, M, I, S, G, N, Y, C, V, T, D, or V. In some embodiments [N4] comprises QNQQ (SEQ ID NO: 5028), WNQQ (SEQ ID NO: 5029), QYYV (SEQ ID NO: 5030), RRQQ (SEQ ID NO: 5031), GCGQ (SEQ ID NO: 5032), LRQQ (SEQ ID NO: 5033), RNQQ (SEQ ID NO: 5034), VNQQ (SEQ ID NO: 5035), FRLQ (SEQ ID NO: 5036), FNQQ (SEQ ID NO: 5037), LLQQ (SEQ ID NO: 5038), SNQQ (SEQ ID NO: 5039), RLQQ (SEQ ID NO: 5040), LNQQ (SEQ ID NO: 5041), QRKL (SEQ ID NO: 5042), LRRQ (SEQ ID NO: 5043), QRLR (SEQ ID NO: 5044), QRRL (SEQ ID NO: 5045), RRLQ (SEQ ID NO: 5046), RLRQ (SEQ ID NO: 5047), SKRQ (SEQ ID NO: 5048), QLYR (SEQ ID NO: 5049), QLTV (SEQ ID NO: 5050), QNKQ (SEQ ID NO: 5051), KNQQ (SEQ ID NO: 5052), QKQQ (SEQ ID NO: 5053), QTQQ (SEQ ID NO: 5054), QNHQ (SEQ ID NO: 5055), QHQQ (SEQ ID NO: 5056), QNQH (SEQ ID NO: 5057), QHRQ (SEQ ID NO: 5058), LTQQ (SEQ ID NO: 5059), QNQW (SEQ ID NO: 5060), QNTH (SEQ ID NO: 5061), RRRQ (SEQ ID NO: 5062), QYQQ (SEQ ID NO: 5063), QNDQ (SEQ ID NO: 5064), QNRH (SEQ ID NO: 5065), RDQQ (SEQ ID NO: 5066), PNLQ (SEQ ID NO: 5067), HVRQ (SEQ ID NO: 5068), PNQH (SEQ ID NO: 5069), HNQQ (SEQ ID NO: 5070), QSQQ (SEQ ID NO: 5071), QPAK (SEQ ID NO: 5072), QNLA (SEQ ID NO: 5073), QNQL (SEQ ID NO: 5074), QGQQ (SEQ ID NO: 5075), LNRQ (SEQ ID NO: 5076), QNPP (SEQ ID NO: 5077), QNLQ (SEQ ID NO: 5078), QDQE (SEQ ID NO: 5079), QDQQ (SEQ ID NO: 5080), HWQQ (SEQ ID NO: 5081), PNQQ (SEQ ID NO: 5082), PEQQ (SEQ ID NO: 5083), QRTM (SEQ ID NO: 5084), LHQH (SEQ ID NO: 5085), QHRI (SEQ ID NO: 5086), QYIH (SEQ ID NO: 5087), QKFE (SEQ ID NO: 5088), QFPS (SEQ ID NO: 5089), QNPL (SEQ ID NO: 5090), QAIK (SEQ ID NO: 5091), QNRQ (SEQ ID NO: 5092), QYQH (SEQ ID NO: 5093), QNPQ (SEQ ID NO: 5094), QHQL (SEQ ID NO: 5095), QSPP (SEQ ID NO: 5096), QAKL (SEQ ID NO: 5097), KSQQ (SEQ ID NO: 5098), QDRP (SEQ ID NO: 5099), QNLG (SEQ ID NO: 5100), QAFH (SEQ ID NO: 5101), QNAQ (SEQ ID NO: 5102), HNQL (SEQ ID NO: 5103), QKLN (SEQ ID NO: 5104), QNVQ (SEQ ID NO: 5105), QAQQ (SEQ ID NO: 5106), QTPP (SEQ ID NO: 5107), QPPA (SEQ ID NO: 5108), QERP (SEQ ID NO: 5109), QDLQ (SEQ ID NO: 5110), QAMH (SEQ ID NO: 5111), QHPS (SEQ ID NO: 5112), PGLQ (SEQ ID NO: 5113), QGIR (SEQ ID NO: 5114), QAPA (SEQ ID NO: 5115), QIPP (SEQ ID NO: 5116), QTQL (SEQ ID NO: 5117), QAPS (SEQ ID NO: 5118), QNTY (SEQ ID NO: 5119), QDKQ (SEQ ID NO: 5120), QNHL (SEQ ID NO: 5121), QIGM (SEQ ID NO: 5122), LNKQ (SEQ ID NO: 5123), PNQL (SEQ ID NO: 5124), QLQQ (SEQ ID NO: 5125), QRMS (SEQ ID NO: 5126), QGIL (SEQ ID NO: 5127), QDRQ (SEQ ID NO: 5128), RDWQ (SEQ ID NO: 5129), QERS (SEQ ID NO: 5130), QNYQ (SEQ ID NO: 5131), QRTC (SEQ ID NO: 5132), QIGH (SEQ ID NO: 5133), QGAI (SEQ ID NO: 5134), QVPP (SEQ ID NO: 5135), QVQQ (SEQ ID NO: 5136), LMRQ (SEQ ID NO: 5137), QYSV (SEQ ID NO: 5138), QAIT (SEQ ID NO: 5139), QKTL (SEQ ID NO: 5140), QLHH (SEQ ID NO: 5141), QNII (SEQ ID NO: 5142), QGHH (SEQ ID NO: 5143), QSKV (SEQ ID NO: 5144), QLPS (SEQ ID NO: 5145), IGKQ (SEQ ID NO: 5146), QAIH (SEQ ID NO: 5147), QHGL (SEQ ID NO: 5148), QFMC (SEQ ID NO: 5149), QNQM (SEQ ID NO: 5150), QHLQ (SEQ ID NO: 5151), QPAR (SEQ ID NO: 5152), QSLQ (SEQ ID NO: 5153), QSQL (SEQ ID NO: 5154), HSQQ (SEQ ID NO: 5155), QMPS (SEQ ID NO: 5156), QGSL (SEQ ID NO: 5157), QVPA (SEQ ID NO: 5158), HYQQ (SEQ ID NO: 5159), QVPS (SEQ ID NO: 5160), RGEQ (SEQ ID NO: 5161), PGQQ (SEQ ID NO: 5162), LEQQ (SEQ ID NO: 5163), QNQS (SEQ ID NO: 5164), QKVI (SEQ ID NO: 5165), QNND (SEQ ID NO: 5166), QSVH (SEQ ID NO: 5167), QPLG (SEQ ID NO: 5168), HNQE (SEQ ID NO: 5169), QIQQ (SEQ ID NO: 5170), QVRN (SEQ ID NO: 5171), PSNQ (SEQ ID NO: 5172), QVGH (SEQ ID NO: 5173), QRDI (SEQ ID NO: 5174), QMPN (SEQ ID NO: 5175), RGLQ (SEQ ID NO: 5176), PSLQ (SEQ ID NO: 5177), QRDQ (SEQ ID NO: 5178), QAKG (SEQ ID NO: 5179), QSAH (SEQ ID NO: 5180), QSTM (SEQ ID NO: 5181), QREM (SEQ ID NO: 5182), QYRA (SEQ ID NO: 5183), QRQQ (SEQ ID NO: 5184), QWQQ (SEQ ID NO: 5185), QRMN (SEQ ID NO: 5186), GDSQ (SEQ ID NO: 5187), QKIS (SEQ ID NO: 5188), PSMQ (SEQ ID NO: 5189), SPRQ (SEQ ID NO: 5190), MEQQ (SEQ ID NO: 5191), QYQN (SEQ ID NO:

5192), QIRQ (SEQ ID NO: 5193), QSVQ (SEQ ID NO: 5194), RSQQ (SEQ ID NO: 5195), QNKL (SEQ ID NO: 5196), QIQH (SEQ ID NO: 5197), PRQQ (SEQ ID NO: 5198), HTQQ (SEQ ID NO: 5199), QRQH (SEQ ID NO: 5200), RNQE (SEQ ID NO: 5201), QSKQ (SEQ ID NO: 5202), QNQP (SEQ ID NO: 5203), QSPQ (SEQ ID NO: 5204), QTRQ (SEQ ID NO: 5205), QNLH (SEQ ID NO: 5206), QNQE (SEQ ID NO: 5207), LNQP (SEQ ID NO: 5208), QNQD (SEQ ID NO: 5209), QNLL (SEQ ID NO: 5210), QLVI (SEQ ID NO: 5211), RTQE (SEQ ID NO: 5212), QTHQ (SEQ ID NO: 5213), QDQH (SEQ ID NO: 5214), QSQH (SEQ ID NO: 5215), VRQQ (SEQ ID NO: 5216), AWQQ (SEQ ID NO: 5217), QSVP (SEQ ID NO: 5218), QNIQ (SEQ ID NO: 5219), LDQQ (SEQ ID NO: 5220), PDQQ (SEQ ID NO: 5221), ESQQ (SEQ ID NO: 5222), QRQL (SEQ ID NO: 5223), QIIV (SEQ ID NO: 5224), QKQS (SEQ ID NO: 5225), QSHQ (SEQ ID NO: 5226), QFVV (SEQ ID NO: 5227), QSQP (SEQ ID NO: 5228), QNEQ (SEQ ID NO: 5229), INQQ (SEQ ID NO: 5230), RNRQ (SEQ ID NO: 5231), RDQK (SEQ ID NO: 5232), QWKR (SEQ ID NO: 5233), ENRQ (SEQ ID NO: 5234), QTQP (SEQ ID NO: 5235), QKQL (SEQ ID NO: 5236), RNQL (SEQ ID NO: 5237), ISIQ (SEQ ID NO: 5238), QTVC (SEQ ID NO: 5239), QQIM (SEQ ID NO: 5240), LNHQ (SEQ ID NO: 5241), QNQA (SEQ ID NO: 5242), QMIH (SEQ ID NO: 5243), RNHQ (SEQ ID NO: 5244), or QKMN (SEQ ID NO: 5245), or any dipeptide or tripeptide thereof. In some embodiments, [N1]-[N2]-[N3]-[N4] is or comprises: the amino acid sequence of any of SEQ ID NOs: 1800-2241; an amino acid sequence comprising any portion of any of the aforesaid amino acid sequences (e.g., any 2, 3, 4, 5, 6, 7, 8, 9, 10, 11, or 12 amino acids, e.g., consecutive amino acids) thereof; an amino acid sequence comprising one, two, or three but no more than four modifications, e.g., substitutions (e.g., conservative substitutions), insertions, or deletions, relative to any of the aforesaid amino acid sequences; or an amino acid sequence comprising one, two, or three but no more than four different amino acids, relative to any one of the aforesaid amino acid sequences. In some embodiments, [N1]-[N2]-[N3]-[N4] is or comprises GSGSPHSKAQNQQ (SEQ ID NO: 1801). In some embodiments, [N1]-[N2]-[N3]-[N4] is or comprises GHDSPHKSGQNQQ (SEQ ID NO: 1800).

In some embodiments, the AAV capsid variant comprising an amino acid sequence having the formula [N1]-[N2]-[N3], further comprises [N0], wherein [N0] comprises XA XB and XC. In some embodiments, XA of [N0] is T, S, Y, M, A, C, I, R, L, D, F, V, Q, N, H, E, or G. In some embodiments, XB of [N0] is I, M, P, E, N, D, S, A, T, G, Q, F, V, L, C, H, R, W, or L. In some embodiments, XC of [N0] is N, M, E, G, Y, W, T, I, Q, F, V, A, L, I, P, K, R, H, S, D, or S. In some embodiments, [N0] comprises TIN, SMN, TIM, YLS, GLS, MPE, MEG, MEY, AEW, CEW, ANN, IPE, ADM, IEY, ADY, IET, MEW, CEY, RIN, MEI, LEY, ADW, IEI, DIM, FEQ, MEF, CDQ, LPE, IEN, MES, AEI, VEY, IIN, TSN, IEV, MEM, AEV, MDA, VEW, AEQ, LEW, MEL, MET, MEA, IES, MEV, CEI, ATN, MDG, QEV, ADQ, NMN, IEM, ISN, TGN, QQQ, HDW, IEG, TII, TFP, TEK, EIN, TVN, TFN, SIN, TER, TSY, ELH, AIN, SVN, TDN, TFH, TVH, TEN, TSS, TID, TCN, NIN, TEH, AEM, AIK, TDK, TFK, SDQ, TEI, NTN, TET, SIK, TEL, TEA, TAN, TIY, TFS, TES, TTN, TED, TNN, EVH, TIS, TVR, TDR, TIK, NHI, TIP, ESD, TDL, TVP, TVI, AEH, NCL, TVK, NAD, TIT, NCV, TIR, NAL, VIN, TIQ, TEF, TRE, QGE, SEK, NVN, GGE, EFV, SDK, TEQ, EVQ, TEY, NCW, TDV, SDI, NSI, NSL, EVV, TEP, SEL, TWQ, TEV, AVN, GVL, TLN, TEG, TRD, NAI, AEN, AET, ETA, NNL, or any dipeptide thereof. In some embodiments, [N0]-[N1]-[N2]-[N3]-[N4] is or comprises the amino acid sequence of any one of SEQ ID NOs: 2242-2886; an amino acid sequence comprising any portion of any of the aforesaid amino acid sequences (e.g., any 2, 3, 4, 5, 6, 7, 8, 9, 10, 11, 12, 13, 14, or 15 amino acids, e.g., consecutive amino acids) thereof; an amino acid sequence comprising one, two, or three but no more than four modifications, e.g., substitutions (e.g., conservative substitutions), insertions, or deletions, relative to any of the aforesaid amino acid sequences; or an amino acid sequence comprising one, two, or three but no more than four different amino acids, relative to any one of the aforesaid amino acid sequences. In some embodiments, [N0]-[N1]-[N2]-[N3]-[N4] is or comprises TINGSGSPHSKAQNQQ (SEQ ID NO: 2242). In some embodiments, [N0]-[N1]-[N2]-[N3]-[N4] is or comprises TINGHDSPHKSGQNQQ (SEQ ID NO: 2243).

In some embodiments, [N1]-[N2]-[N3] is present in loop IV of the AAV capsid variant. In some embodiments [N0] and [N4] are present in loop IV of the AAV capsid variant. In some embodiments, [N0]-[N1]-[N2]-[N3]-[N4] is present in loop IV of the AAV capsid variant. In some embodiments, [N0] is present immediately subsequent to position 449, relative to a reference sequence numbered according to the amino acid sequence of SEQ ID NO: 138. In some embodiments, wherein [N0] is present immediately subsequent to position 449, relative to a reference sequence numbered according to the amino acid sequence of SEQ ID NO: 981 or 982. In some embodiments, [N0] replaces positions 450, 451, and 452 (e.g., amino acids T450, I451, and N452), relative to a reference sequence numbered according to SEQ ID NO: 138, 981, or 982. wherein [N0] is present immediately subsequent to position 449 and wherein [N0] replaces positions 450-452 (e.g., T450, I451, and N452), relative to a reference sequence numbered according to SEQ ID NO: 138, 981, or 982. In some embodiments, [N1] is present immediately subsequent to position 452, relative to a reference sequence numbered according to the amino acid sequence of SEQ ID NO: 138, 981 or 982. In some embodiments, wherein [N1] replaces positions 453-455 (e.g., G453, S454, and G455), relative to a reference sequence numbered according to SEQ ID NO: 138, 981, or 982. In some embodiments, [N1] is present immediately subsequent to position 452 and wherein [N1] replaces positions 453-455 (e.g., G453, S454, and G455), relative to a reference sequence numbered according to SEQ ID NO: 138, 981, or 982. In some embodiments, [N2] is present immediately subsequent to position 455, relative to a reference sequence numbered according to the amino acid sequence of SEQ ID NO: 138, 981, or 982. In some embodiments, [N2]-[N3] is present immediately subsequent to position 455, relative to a reference sequence numbered according to the amino acid sequence of SEQ ID NO: 138, 981, or 982. In some embodiments [N1]-[N2]-[N3] is present immediately subsequent to position 452, numbered relative to SEQ ID NO: 138, 981, or 982. In some embodiments, [N1]-[N2]-[N3] replaces positions 453-455 (e.g., G453, S454, and G455), relative to a reference sequence numbered according to SEQ ID NO: 138, 981, or 982. In some embodiments, [N1] is present immediately subsequent to position 452 and wherein [N1]-[N2]-[N3] replaces positions 453-455 (e.g., G453, S454, and G455), relative to a reference sequence numbered according to SEQ ID NO: 138, 981, or 982. In some embodiments, [N4] is present immediately subsequent to position 455, relative to a reference sequence numbered according to the amino acid sequence of SEQ ID NO: 138. In some embodiments, [N4] replaces positions 456-459

(e.g., Q456, N457, Q458, and Q459), relative to a reference sequence numbered according to the amino acid sequence of SEQ ID NO: 138. In some embodiments, [N4] is present immediately subsequent to position 455, and [N4] replaces positions 456-459 (e.g., Q456, N457, Q458, and Q459), relative to a reference sequence numbered according to the amino acid sequence of SEQ ID NO: 138. In some embodiments, [N2]-[N3]-[N4] replaces positions 456-459 (e.g., Q456, N457, Q458, and Q459), relative to a reference sequence numbered according to the amino acid sequence of SEQ ID NO: 138. In some embodiments, [N2]-[N3]-[N4] is present immediately subsequent to position 455, and wherein [N2]-[N3]-[N4] replaces positions 456-459 (e.g., Q456, N457, Q458, and Q459), relative to a reference sequence numbered according to the amino acid sequence of SEQ ID NO: 138. In some embodiments, [N1]-[N2]-[N3]-[N4] replaces positions 453-459 (e.g., G453, S454, G455, Q456, N457, Q458, and Q459), relative to a reference sequence numbered according to the amino acid sequence of SEQ ID NO: 138. In some embodiments, [N1]-[N2]-[N3]-[N4] is present immediately subsequent to position 452, and wherein [N1]-[N2]-[N3]-[N4] replaces positions 453-459 (e.g., G453, S454, G455, Q456, N457, Q458, and Q459), relative to a reference sequence numbered according to the amino acid sequence of SEQ ID NO: 138. In some embodiments, [N0]-[N1]-[N2]-[N3]-[N4] replaces positions 450-456 (e.g., T450, I451, N452, G453, S454, G455, Q456, N457, Q458, and Q459), relative to a reference sequence numbered according to the amino acid sequence of SEQ ID NO: 138. In some embodiments, [N0]-[N1]-[N2]-[N3]-[N4] is present immediately subsequent to position 449, and wherein [N0]-[N1]-[N2]-[N3]-[N4] replaces positions 450-456 (e.g., T450, I451, N452, G453, S454, G455, Q456, N457, Q458, and Q459), relative to a reference sequence numbered according to the amino acid sequence of SEQ ID NO: 138.

In some embodiments, [N3] is present immediately subsequent to [N2].

In some embodiments, the AAV capsid variant comprises from N-terminus to C-terminus, [N2]-[N3]. In some embodiments, the AAV capsid variant comprises from N-terminus to C-terminus, [N1]-[N2]-[N3]. In some embodiments, the AAV capsid variant comprises from N-terminus to C-terminus, [N1]-[N2]-[N3]-[N4]. In some embodiments, the AAV capsid variant comprises from N-terminus to C-terminus, [N0]-[N1]-[N2]-[N3]. In some embodiments, the AAV capsid variant comprises from N-terminus to C-terminus, [N0]-[N1]-[N2]-[N3]-[N4].

In some embodiments, an AAV capsid variant described herein comprises an amino acid sequence having the formula [A][B] (SEQ ID NO: 4694), wherein [A] comprises the amino acid sequence of GSGSPH (SEQ ID NO: 4695) and [B] comprises X1 X2 X3 X4 X5 X6 X7. In some embodiments, position X1 of [B] is S, C, F, or V. In some embodiments, position X2 of [B] is K, L, R, I, E, Y, V, or S. In some embodiments, X3 of [B] is A, R, L, G, I, Y, S, F, or W. In some embodiments X4 of [B] is W, Q, R, G, L, V, S, or F. In some embodiments, position X5 of [B] is N, Y, R, C, K, or L. In some embodiments, position X6 of [B] is Q, G, K, R, T, L, or Y. In some embodiment, position X7 of [B] is Q, L, R, or V. In some embodiments, [B] comprises S LLWNQQ (SEQ ID NO: 5247), SKAQYYV (SEQ ID NO: 5248), SKLRRQQ (SEQ ID NO: 5249), SIWQNQQ (SEQ ID NO: 5250), SKAGCGQ (SEQ ID NO: 5251), SRAQNQQ (SEQ ID NO: 5252), SKRLRQQ (SEQ ID NO: 5253), SLRRNQQ (SEQ ID NO: 5254), SRGRNQQ (SEQ ID NO: 5255), SEIVNQQ (SEQ ID NO: 5256), SSRRNQQ (SEQ ID NO: 5257), CLLQNQQ (SEQ ID NO: 5258), SKAFRLQ (SEQ ID NO: 5259), CLAQNQQ (SEQ ID NO: 5260), FLRQNQQ (SEQ ID NO: 5261), SLRFNQQ (SEQ ID NO: 5262), SYLRNQQ (SEQ ID NO: 5263), CSLQNQQ (SEQ ID NO: 5264), VLWQNQQ (SEQ ID NO: 5265), SKWLLQQ (SEQ ID NO: 5266), SLWSNQQ (SEQ ID NO: 5267), SKRRLQQ (SEQ ID NO: 5268), SVYLNQQ (SEQ ID NO: 5269), SLWLNQQ (SEQ ID NO: 5270), SKAQRKL (SEQ ID NO: 5271), SKALRRQ (SEQ ID NO: 5272), SKAQRLR (SEQ ID NO: 5273), SKAQNQQ (SEQ ID NO: 5274), SKAQRRL (SEQ ID NO: 5275), SKARRQQ (SEQ ID NO: 5276), SKARRLQ (SEQ ID NO: 5277), SKSRRQQ (SEQ ID NO: 5278), SKARLRQ (SEQ ID NO: 5279), SKASKRQ (SEQ ID NO: 5280), VRRQNQQ (SEQ ID NO: 5281), SKAQLYR (SEQ ID NO: 5282), SLFRNQQ (SEQ ID NO: 5283), SKAQLTV (SEQ ID NO: 5284), or any dipeptide, tripeptide, tetrapeptide, pentapeptide, or hexapeptide thereof. In some embodiments, [A][B] comprises GSGSPHSLLWNQQ (SEQ ID NO: 5285), GSGSPHSKAQYYV (SEQ ID NO: 2060), GSGSPHSKLRRQQ (SEQ ID NO: 2061), GSGSPHSIWQNQQ (SEQ ID NO: 5286), GSGSPHSKAGCGQ (SEQ ID NO: 2062), GSGSPHSRAQNQQ (SEQ ID NO: 2063), GSGSPHSKRLRQQ (SEQ ID NO: 2064), GSGSPHSLRRNQQ (SEQ ID NO: 2065), GSGSPHSRGRNQQ (SEQ ID NO: 2066), GSGSPHSEIVNQQ (SEQ ID NO: 5287), GSGSPHSSRRNQQ (SEQ ID NO: 2067), GSGSPHCLLQNQQ (SEQ ID NO: 5288), GSGSPHSKAFRLQ (SEQ ID NO: 2068), GSGSPHCLAQNQQ (SEQ ID NO: 5289), GSGSPHFLRQNQQ (SEQ ID NO: 2070), GSGSPHSLRFNQQ (SEQ ID NO: 2071), GSGSPHSYLRNQQ (SEQ ID NO: 5290), GSGSPHCSLQNQQ (SEQ ID NO: 5291), GSGSPHVLWQNQQ (SEQ ID NO: 5292), GSGSPHSKWLLQQ (SEQ ID NO: 2072), GSGSPHSLWSNQQ (SEQ ID NO: 5293), GSGSPHSKRRLQQ (SEQ ID NO: 2073), GSGSPHSVYLNQQ (SEQ ID NO: 5294), GSGSPHSLWLNQQ (SEQ ID NO: 5295), GSGSPHSKAQRKL (SEQ ID NO: 2074), GSGSPHSKALRRQ (SEQ ID NO: 2075), GSGSPHSKAQRLR (SEQ ID NO: 2076), GSGSPHSKAQNQQ (SEQ ID NO: 1801), GSGSPHSKAQRRL (SEQ ID NO: 2077), GSGSPHSKARRQQ (SEQ ID NO: 2078), GSGSPHSKARRLQ (SEQ ID NO: 2079), GSGSPHSKSRRQQ (SEQ ID NO: 2080), GSGSPHSKARLRQ (SEQ ID NO: 2082), GSGSPHSKASKRQ (SEQ ID NO: 2083), GSGSPHVRRQNQQ (SEQ ID NO: 2084), GSGSPHSKAQLYR (SEQ ID NO: 2085), GSGSPHSLFRNQQ (SEQ ID NO: 5296), GSGSPHSKAQLTV (SEQ ID NO: 2086), or any portion thereof, e.g., any 2, 3, 4, 5, 6, 7, 8, 9, 10, 11, or 12 amino acids, e.g., consecutive amino acids, thereof.

In some embodiments, [A][B] is present in loop IV of the AAV capsid variant. In some embodiments, [A] is present immediately subsequent to position 452, relative to a reference sequence numbered according to the amino acid sequence of SEQ ID NO: 138. In some embodiments, [A] replaces positions 453-455 (e.g., G453, S454, G455), relative to a reference sequence numbered according to the amino acid sequence of SEQ ID NO: 138. In some embodiments, [A] is present immediately subsequent to position 452, and wherein [A] replaces positions 453-455 (e.g., G453, S454, G455), relative to a reference sequence numbered according to the amino acid sequence of SEQ ID NO: 138. In some embodiments, [B] is present immediately subsequent to [A]. In some embodiments, [B] replaces positions 456-459 (e.g., Q456, N457, Q458, Q459), relative to a reference sequence numbered according to the amino acid sequence of SEQ ID NO: 138. In some embodiments,

[A][B] replaces positions 453-459 (e.g., G453, S454, G455, Q456, N457, Q458, Q459), relative to a reference sequence numbered according to the amino acid sequence of SEQ ID NO: 138. In some embodiments, [A][B] is present immediately subsequent to position 452, and wherein [A][B] replaces positions 453-459 (e.g., G453, S454, G455, Q456, N457, Q458, Q459), relative to a reference sequence numbered according to the amino acid sequence of SEQ ID NO: 138. In some embodiments, the AAV capsid variant comprises from N-terminus to C-terminus, [A][B].

In some embodiments, an AAV capsid variant described herein comprises an amino acid sequence having the formula [A][B] (SEQ ID NO: 4699), wherein [A] comprises X1 X2 X3 X4 X5 X6 and [B] comprises SPHKSG (SEQ ID NO: 946). In some embodiments, position X1 of [A] is T, M, A, C, I, R, L, D, F, V, Q, N, or H. In some embodiments, position X2 of [A] is I, P, E, N, D, S, A, T, M, or Q. In some embodiments, position X3 of [A] is N, E, G, Y, W, M, T, I, K, Q, F, S, V, A, or L. In some embodiments, position X4 of [A] is G, D, R, or E. In some embodiments, position X5 of [A] is H, Q, N, or D. In some embodiments, position X6 of [A] is D or R. In some embodiments, [A] comprises TINGHD (SEQ ID NO: 5297), MPEGHD (SEQ ID NO: 5298), MEGGHD (SEQ ID NO: 5299), MEYGHD (SEQ ID NO: 5300), AEWGHD (SEQ ID NO: 5301), CEWGHD (SEQ ID NO: 5302), ANNGQD (SEQ ID NO: 5303), IPEGHD (SEQ ID NO: 5304), ADMGHD (SEQ ID NO: 5305), IEYGHD (SEQ ID NO: 5306), ADYGHD (SEQ ID NO: 5307), IETGHD (SEQ ID NO: 5308), MEWGHD (SEQ ID NO: 5309), CEYGHD (SEQ ID NO: 5310), RINGHD (SEQ ID NO: 5311), MEIGHD (SEQ ID NO: 5312), LEYGHD (SEQ ID NO: 5313), ADWGHD (SEQ ID NO: 5314), IEIGHD (SEQ ID NO: 5315), TIKDND (SEQ ID NO: 5316), DIMGHD (SEQ ID NO: 5317), FEQGHD (SEQ ID NO: 5318), MEFGHD (SEQ ID NO: 5319), CDQGHD (SEQ ID NO: 5320), LPEGHD (SEQ ID NO: 5321), IENGHD (SEQ ID NO: 5322), MESGHD (SEQ ID NO: 5323), AEIGHD (SEQ ID NO: 5324), VEYGHD (SEQ ID NO: 5325), TSNGDD (SEQ ID NO: 5326), IEVGHD (SEQ ID NO: 5327), MEMGHD (SEQ ID NO: 5328), AEVGHD (SEQ ID NO: 5329), MDAGHD (SEQ ID NO: 5330), VEWGHD (SEQ ID NO: 5331), AEQGHD (SEQ ID NO: 5332), LEWGHD (SEQ ID NO: 5333), MELGHD (SEQ ID NO: 5334), METGHD (SEQ ID NO: 5335), MEAGHD (SEQ ID NO: 5336), TINRQR (SEQ ID NO: 5337), IESGHD (SEQ ID NO: 5338), TAKDHD (SEQ ID NO: 5339), MEVGHD (SEQ ID NO: 5340), CEIGHD (SEQ ID NO: 5341), ATNGHD (SEQ ID NO: 5342), MDGGHD (SEQ ID NO: 5343), QEVGHD (SEQ ID NO: 5344), ADQGHD (SEQ ID NO: 5345), NMNGHD (SEQ ID NO: 5346), TPWEHD (SEQ ID NO: 5347), IEMGHD (SEQ ID NO: 5348), TANEHD (SEQ ID NO: 5349), QQQGHD (SEQ ID NO: 5350), TPQDHD (SEQ ID NO: 5351), HDWGHD (SEQ ID NO: 5352), IEGGHD (SEQ ID NO: 5353), or any dipeptide, tripeptide, tetrapeptide, or pentapeptide thereof. In some embodiments, [A][B] comprises TINGHDSPHKR (SEQ ID NO: 5354), MPEGHDSPHKS (SEQ ID NO: 5355), MEGGHDSPHKS (SEQ ID NO: 5356), MEYGHDSPHKS (SEQ ID NO: 5357), AEWGHDSPHKS (SEQ ID NO: 5358), CEWGHDSPHKS (SEQ ID NO: 5359), ANNGQDSPHKS (SEQ ID NO: 5360), IPEGHDSPHKS (SEQ ID NO: 5361), ADMGHDSPHKS (SEQ ID NO: 5362), IEYGHDSPHKS (SEQ ID NO: 5363), ADYGHDSPHKS (SEQ ID NO: 5364), IETGHDSPHKS (SEQ ID NO: 5365), MEWGHDSPHKS (SEQ ID NO: 5366), CEYGHDSPHKS (SEQ ID NO: 5367), RINGHDSPHKS (SEQ ID NO: 5368), MEIGHDSPHKS (SEQ ID NO: 5369), LEYGHDSPHKS (SEQ ID NO: 5370), ADWGHDSPHKS (SEQ ID NO: 5371), IEIGHDSPHKS (SEQ ID NO: 5372), TIKDNDSPHKS (SEQ ID NO: 5373), DIMGHDSPHKS (SEQ ID NO: 5374), FEQGHDSPHKS (SEQ ID NO: 5375), MEFGHDSPHKS (SEQ ID NO: 5376), CDQGHDSPHKS (SEQ ID NO: 5377), LPEGHDSPHKS (SEQ ID NO: 5378), IENGHDSPHKS (SEQ ID NO: 5379), MESGHDSPHKS (SEQ ID NO: 5380), AEIGHDSPHKS (SEQ ID NO: 5381), VEYGHDSPHKS (SEQ ID NO: 5382), TSNGDDSPHKS (SEQ ID NO: 5383), IEVGHDSPHKS (SEQ ID NO: 5384), MEMGHDSPHKS (SEQ ID NO: 5385), AEVGHDSPHKS (SEQ ID NO: 5386), MDAGHDSPHKS (SEQ ID NO: 5387), VEWGHDSPHKS (SEQ ID NO: 5388), AEQGHDSPHKS (SEQ ID NO: 5389), LEWGHDSPHKS (SEQ ID NO: 5390), MELGHDSPHKS (SEQ ID NO: 5391), METGHDSPHKS (SEQ ID NO: 5392), MEAGHDSPHKS (SEQ ID NO: 5393), TINRQRSPHKS (SEQ ID NO: 5394), IESGHDSPHKS (SEQ ID NO: 5395), TAKDHDSPHKS (SEQ ID NO: 5396), MEVGHDSPHKS (SEQ ID NO: 5397), CEIGHDSPHKS (SEQ ID NO: 5398), ATNGHDSPHKS (SEQ ID NO: 5399), MDGGHDSPHKS (SEQ ID NO: 5400), QEVGHDSPHKS (SEQ ID NO: 5401), ADQGHDSPHKS (SEQ ID NO: 5402), NMNGHDSPHKS (SEQ ID NO: 5403), TPWEHDSPHKS (SEQ ID NO: 5404), IEMGHDSPHKS (SEQ ID NO: 5405), TANEHDSPHKS (SEQ ID NO: 5406), TINGHDSPHKS (SEQ ID NO: 5407), QQQGHDSPHKS (SEQ ID NO: 5408), TPQDHDSPHKS (SEQ ID NO: 5409), HDWGHDSPHKS (SEQ ID NO: 5410), IEGGHDSPHKS (SEQ ID NO: 5411), or any portion thereof, e.g., any 2, 3, 4, 5, 6, 7, 8, 9, 10, 11, or 12 amino acids, e.g., consecutive amino acids, thereof.

In some embodiments, [A][B] is present in loop IV of the AAV capsid variant. In some embodiments, [A] is present immediately subsequent to position 449, relative to a reference sequence numbered according to the amino acid sequence of SEQ ID NO: 138. In some embodiments, [A] replaces positions 450-455 (e.g., T450, I451, N452, G453, S454, G455), relative to a reference sequence numbered according to the amino acid sequence of SEQ ID NO: 138. In some embodiments, [A] is present immediately subsequent to position 449, and wherein [A] replaces positions 450-455 (e.g., T450, I451, N452, G453, S454, G455), relative to a reference sequence numbered according to the amino acid sequence of SEQ ID NO: 138. In some embodiments, [B] is present immediately subsequent to [A]. In some embodiments, [A][B] replaces positions 450-455 (e.g., T450, I451, N452, G453, S454, G455), relative to a reference sequence numbered according to the amino acid sequence of SEQ ID NO: 138. In some embodiments, [A][B] is present immediately subsequent to position 449, and wherein [A][B] replaces positions 450-455 (e.g., T450, I451, N452, G453, S454, G455), relative to a reference sequence numbered according to the amino acid sequence of SEQ ID NO: 138. In some embodiments, the peptide comprises from N-terminus to C-terminus, [A][B].

In some embodiments, an AAV capsid variant described herein comprises an amino acid sequence comprising at least 3, 4, 5, 6, 7, 8, 9, 10, 11, 12, 13, 16, or 17 consecutive amino acids from any one of the sequences provided in Tables 1, 2A, 2B, 13-19. In some embodiments, the AAV capsid variant comprises an amino acid sequence comprising at least 3, 4, or 5 consecutive amino acids from any one of SEQ ID NOs: 945-980 or 985-986. In some embodiments, the AAV capsid variant comprises an amino acid sequence comprising at least 3, 4, 5, 6, 7, 8, 9, 10, 11, 12, or 13 consecutive amino acids from any one of SEQ ID NOs: 2, 200, 201, 941, 943, 204, 208, 404, or 903-909. In some embodiments, the amino acid sequence is present in loop IV. In some embodiments, the amino acid sequence is present immediately subsequent to position 448, 452, 453, 455, relative to a reference sequence numbered according to the amino acid sequence of SEQ ID NO: 138, 981, or 982. In some embodiments, the amino acid sequence is present immediately subsequent to position 455, numbered according to SEQ ID NO: 982. In some embodiments, the amino acid sequence is present immediately subsequent to position 455, numbered according to SEQ ID NO: 138. In some embodiments, the amino acid sequence is present immediately subsequent to position 453, numbered according to SEQ ID NO: 981. In some embodiments, the amino acid sequence is present immediately subsequent to position 453, numbered according to SEQ ID NO: 138. In some embodiments, the amino acid sequence replaces 1, 2, 3, 4, 5, 6, 7, 8, 9, 10, 11, or all of positions 499 (e.g., K499), 450 (e.g., T450), 451 (e.g., 1451), 452 (e.g., N452), 453 (e.g., G453), 454 (e.g., S454), 455 (e.g., G455), 456 (e.g., Q456), 457 (e.g., N457), 458 (e.g., Q458), 459 (e.g., Q459), and 460 (e.g., T460), numbered according to SEQ ID NO: 138. In some embodiments, the AAV capsid variant comprises one or more amino acid substitutions at positions 499 (e.g., K499), 450 (e.g., T450), 451 (e.g., 1451), 452 (e.g., N452), 453 (e.g., G453), 454 (e.g., S454), 455 (e.g., G455), 456 (e.g., Q456), 457 (e.g., N457), 458 (e.g., Q458), 459 (e.g., Q459), and/or 460 (e.g., T460), numbered according to SEQ ID NO: 138.

In some embodiments, the 3 consecutive amino acids comprise SPH. In some embodiments, the 4 consecutive amino acids comprise SPHS (SEQ ID NO: 4700). In some embodiments, the 5 consecutive amino acids comprise SPHSK (SEQ ID NO: 4701). In some embodiments, the 6 consecutive amino acids comprise SPHSKA (SEQ ID NO: 941).

In some embodiments, 3 consecutive amino acids comprise HDS. In some embodiments, the 4 consecutive amino acids comprise HDSP (SEQ ID NO: 4702). In some embodiments, the 5 consecutive amino acids comprise HDSPH (SEQ ID NO: 4703). In some embodiments, the 6 consecutive amino acids comprise HDSPHK (SEQ ID NO: 2).

In some embodiments, an AAV capsid variant described herein comprises an amino acid sequence comprising at least one, two, or three but no more than four modifications, e.g., substitutions (e.g., conservative substitutions), insertions, or deletions, relative to the amino acid sequence of any one of the sequences provided in Tables 1, 2A, 2B, 13-19. In some embodiments, the AAV capsid variant comprises an amino acid sequence comprising at least one, two, or three but no more than four different amino acids, relative to the amino acid sequence of any one of the sequences provided in Tables 1, 2A, 2B, 13-19. In some embodiments, the AAV capsid variant comprises an amino acid sequence comprising at least one, two, or three but no more than four modifications, e.g., substitutions (e.g., conservative substitutions), insertions, or deletions, relative to the amino acid sequence of any one of SEQ ID NOs: 945-980 or 985-986. In some embodiments, the AAV capsid variant comprises an amino acid sequence comprising at least one, two, or three but no more than four different amino acids, relative to the amino acid sequence of any one of SEQ ID NOs: 945-980 or 985-986. In some embodiments, the AAV capsid variant comprises an amino acid sequence comprising at least one, two, or three but no more than four modifications, e.g., substitutions (e.g., conservative substitutions), insertions, or deletions, relative to the amino acid sequence of any one of SEQ ID NOs: 2, 200, 201, 941, 943, 204, 208, 404, or 903-909. In some embodiments, the AAV capsid variant comprises an amino acid sequence comprising at least one, two, or three but no more than four different amino acids, from the amino acid sequence of any one of SEQ ID NOs: 2, 200, 201, 941, 943, 204, 208, 404, or 903-909. In some embodiments, the amino acid sequence is present in loop IV. In some embodiments, the amino acid sequence is present immediately subsequent to position 448, 452, 453, 455, relative to a reference sequence numbered according to the amino acid sequence of SEQ ID NO: 138, 981, or 982. In some embodiments, the amino acid sequence is present immediately subsequent to position 455, numbered according to SEQ ID NO: 982. In some embodiments, the amino acid sequence is present immediately subsequent to position 455, numbered according to SEQ ID NO: 138. In some embodiments, the amino acid sequence is present immediately subsequent to position 453, numbered according to SEQ ID NO: 981. In some embodiments, the amino acid sequence is present immediately subsequent to position 453, numbered according to SEQ ID NO: 138. In some embodiments, the amino acid sequence replaces 1, 2, 3, 4, 5, 6, 7, 8, 9, 10, 11, or all of positions 499 (e.g., K499), 450 (e.g., T450), 451 (e.g., 1451), 452 (e.g., N452), 453 (e.g., G453), 454 (e.g., S454), 455 (e.g., G455), 456 (e.g., Q456), 457 (e.g., N457), 458 (e.g., Q458), 459 (e.g., Q459), and 460 (e.g., T460), numbered according to SEQ ID NO: 138.

In some embodiments, the AAV capsid variant comprises an amino acid sequence comprising at least one, two, or three but no more than four modifications, e.g., substitutions (e.g., conservative substitutions), insertions, or deletions, relative to the amino acid sequence of SPHSKA (SEQ ID NO: 941). In some embodiments, the AAV capsid variant comprises an amino acid sequence comprising at least one, two, or three, but no more than four different amino acids from the amino acid sequence of SPHSKA (SEQ ID NO: 941).

In some embodiments, the AAV capsid variant comprises an amino acid sequence comprising at least one, two, or three but no more than four modifications, e.g., substitutions (e.g., conservative substitutions), insertions, or deletions, relative to the amino acid sequence of HDSPHK (SEQ ID NO: 2). In some embodiments, the AAV capsid variant comprises an amino acid sequence comprising at least one, two, or three, but no more than four different amino acids that relative to the amino acid sequence of HDSPHK (SEQ ID NO: 2).

In some embodiments, the AAV capsid variant, comprises the amino acid sequence of any of the sequences provided in Tables 1, 2A, 2B, 13-19. In some embodiments, the peptide comprises the amino acid sequence of any of SEQ ID NOs: 945-980 or 985-986. In some embodiments, the AAV capsid variant comprises the amino acid sequence of any of SEQ ID NOs: 2, 200, 201, 941, 943, 204, 208, 404, or 903-909. In some embodiments, the AAV capsid variant comprises the amino acid sequence of SEQ ID NO: 941. In some embodiments, the AAV capsid variant comprises the amino acid sequence of SEQ ID NO: 2. In some embodiments, the AAV capsid variant comprises the amino acid sequence of SEQ ID NO: 943. In some embodiments, the AAV capsid variant comprises the amino acid sequence of SEQ ID NO: 3589. In some embodiments, the AAV capsid variant comprises the amino acid sequence of SEQ ID NO: 1754. In some embodiments, the amino acid sequence is present in loop IV. In some embodiments, the amino acid sequence is present immediately subsequent to position 448, relative to a reference sequence numbered according to the amino acid sequence of SEQ ID NO: 138. In some embodiments, the amino acid sequence replaces positions 449-460 (e.g., K449, T450, 1451, N452, G453, S454, G455, Q456, N457, Q458, Q459, and T460), numbered relative to SEQ ID NO: 138. In some embodiments, the amino acid sequence is present immediately subsequent to position 448 and replaces positions 449-460 (e.g., K449, T450, 1451, N452, G453, S454, G455, Q456, N457, Q458, Q459, and T460), numbered relative to SEQ ID NO: 138. In some embodiments, the amino acid sequence is present immediately subsequent to position 449, relative to a reference sequence numbered according to the amino acid sequence of SEQ ID NO: 138. In some embodiments, the amino acid sequence replaces positions 450-460 (e.g., T450, 1451, N452, G453, S454, G455, Q456, N457, Q458, Q459, and T460), numbered relative to SEQ ID NO: 138. In some embodiments, the amino acid sequence is present immediately subsequent to position 449, and replaces positions 450-460 (e.g., T450, 1451, N452, G453, S454, G455, Q456, N457, Q458, Q459, and T460), numbered relative to SEQ ID NO: 138. In some embodiments, the amino acid sequence is present immediately subsequent to position 450, relative to a reference sequence numbered according to the amino acid sequence of SEQ ID NO: 138. In some embodiments, the amino acid sequence replaces positions 451-460 (e.g., 1451, N452, G453, S454, G455, Q456, N457, Q458, Q459, and T460), numbered relative to SEQ ID NO: 138. In some embodiments, the amino acid sequence is present immediately subsequent to position 450 and replaces positions 451-460 (e.g., 1451, N452, G453, S454, G455, Q456, N457, Q458, Q459, and T460), numbered relative to SEQ ID NO: 138. In some embodiments, the amino acid sequence is present immediately subsequent to position 451, relative to a reference sequence numbered according to the amino acid sequence of SEQ ID NO: 138. In some embodiments, the amino acid sequence replaces positions 452-460 (e.g., N452, G453, S454, G455, Q456, N457, Q458, Q459, and T460), numbered relative to SEQ ID NO: 138. In some embodiments, the amino acid sequence is present immediately subsequent to position 451 and replaces positions 452-460 (e.g., N452, G453, S454, G455, Q456, N457, Q458, Q459, and T460), numbered relative to SEQ ID NO: 138. In some embodiments, the amino acid sequence is present immediately subsequent to position 452, relative to a reference sequence numbered according to the amino acid sequence of SEQ ID NO: 138. In some embodiments, the amino acid sequence replaces positions 453-460 (e.g., G453, S454, G455, Q456, N457, Q458, Q459, and T460), numbered relative to SEQ ID NO: 138. In some embodiments, the amino acid sequence is present immediately subsequent to position 452, and replaces positions 453-460 (e.g., G453, S454, G455, Q456, N457, Q458, Q459, and T460), numbered relative to SEQ ID NO: 138. In some embodiments, the amino acid sequence is present immediately subsequent to position 453, relative to a reference sequence numbered according to the amino acid sequence of SEQ ID NO: 138. In some embodiments, the amino acid sequence replaces positions 454 and 455 (e.g., S454 and G455), numbered according to SEQ ID NO: 138. In some embodiments, the amino acid sequence is present immediately subsequent to position 453, and replaces positions 454 and 455 (e.g., S454 and G455), numbered according to SEQ ID NO: 138. In some embodiments, the amino acid sequence replaces positions 454-460 (e.g., S454, G455, Q456, N457, Q458, Q459, and T460), numbered relative to SEQ ID NO: 138. In some embodiments, the amino acid sequence is present immediately subsequent to position 453, and replaces positions 454-460 (e.g., S454, G455, Q456, N457, Q458, Q459, and T460), numbered relative to SEQ ID NO: 138. In some embodiments, the amino acid sequence is present immediately subsequent to position 454, relative to a reference sequence numbered according to the amino acid sequence of SEQ ID NO: 138. In some embodiments, the amino acid sequence is present immediately subsequent to position 454, relative to a reference sequence numbered according to the amino acid sequence of SEQ ID NO: 981. In some embodiments, the amino acid sequence replaces positions 455-460 (e.g., positions G455, Q456, N457, Q458, Q459, and T460), numbered relative to SEQ ID NO: 138. In some embodiments, the amino acid sequence is present immediately subsequent to positions 454, and replaces positions 455-460 (e.g., positions G455, Q456, N457, Q458, Q459, and T460), numbered relative to SEQ ID NO: 138. In some embodiments, the amino acid sequence is present immediately subsequent to position 455, relative to a reference sequence numbered according to the amino acid sequence of SEQ ID NO: 138. In some embodiments, the amino acid sequence is present immediately subsequent to position 455, relative to a reference sequence numbered according to the amino acid sequence of SEQ ID NO: 982. In some embodiments, the amino acid sequence replaces positions 456-460 (e.g., Q456, N457, Q458, Q459, and T460), numbered relative to SEQ ID NO: 138. In some embodiments, the amino acid sequence is present immediately subsequent to position 455, and replaces positions 456-460 (e.g., Q456, N457, Q458, Q459, and T460), numbered relative to SEQ ID NO: 138.

In some embodiments, the AAV capsid variant (e.g., an AAV capsid variant described herein), comprises an amino acid sequence encoded by the nucleotide sequence of SEQ ID NO: 942 or 944, or a nucleotide sequence substantially identical (e.g., having at least 70%, 75%, 80%, 85%, 90%, 92%, 95%, 97%, 98%, or 99% sequence identity) thereto. In some embodiments, the AAV capsid variant described herein, comprises an amino acid sequence encoded by the nucleotide sequence of SEQ ID NO: 3 or 942, or a nucleotide sequence comprising at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 3 or 942. In some embodiments, the AAV capsid variant comprises an amino acid sequence encoded by a nucleotide sequence comprising at least one, two, three, four, five, six, or seven, but no more than ten different nucleotides relative to the nucleotide sequence of SEQ ID NO: 3 or 942.

In some embodiments, the nucleotide sequence encoding the AAV capsid variant (e.g., an AAV capsid variant described herein), comprises the nucleotide sequence of SEQ ID NO: 942, or a nucleotide sequence substantially identical (e.g., having at least 70%, 75%, 80%, 85%, 90%, 92%, 95%, 97%, 98%, or 99% sequence identity) thereto. In some embodiments, the nucleic acid sequence encoding the AAV capsid variant comprises a nucleotide sequence comprising at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequences of SEQ ID NO: 942. In some embodiments, the nucleotide sequence encoding an AAV capsid variant described herein comprises a nucleotide sequence comprising at least one, two, three, four, five, six, or seven, but no more than ten different nucleotides, relative to the nucleotide sequence of SEQ ID NO: 942.

In some embodiments, the nucleotide sequence encoding the AAV capsid variant (e.g., an AAV capsid variant described herein), comprises the nucleotide sequence of SEQ ID NO: 3, or a nucleotide sequence substantially identical (e.g., having at least 70%, 75%, 80%, 85%, 90%, 92%, 95%, 97%, 98%, or 99% sequence identity) thereto. In some embodiments, the nucleic acid sequence encoding the AAV capsid variant comprises a nucleotide sequence comprising at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequences of SEQ ID NO: 3. In some embodiments, the nucleotide sequence encoding an AAV capsid variant described herein comprises a nucleotide sequence comprising at least one, two, three, four, five, six, or seven, but no more than ten different nucleotides relative to the nucleotide sequence of SEQ ID NO: 3.

In some embodiments, an AAV capsid variant described herein comprises the amino acid sequence of SPHSKA (SEQ ID NO: 941), wherein the amino acid sequence is present immediately subsequent to position 455, relative to a reference sequence numbered according to the amino acid sequence of SEQ ID NO: 138. In some embodiments, an AAV capsid variant described herein comprises the amino acid sequence of SPHSKA (SEQ ID NO: 941), wherein the amino acid sequence is present immediately subsequent to position 455, relative to a reference sequence numbered according to the amino acid sequence of SEQ ID NO: 981.

In some embodiments, an AAV capsid variant described herein comprises the amino acid sequence of HDSPHK (SEQ ID NO: 2), wherein the amino acid sequence is present immediately subsequent to position 453, relative to a reference sequence numbered according to the amino acid sequence of SEQ ID NO: 138. In some embodiments, an AAV capsid variant described herein comprises the amino acid sequence of HDSPHK (SEQ ID NO: 2), wherein the amino acid sequence is present immediately subsequent to position 453, relative to a reference sequence numbered according to the amino acid sequence of SEQ ID NO: 982.

In some embodiments, an AAV capsid variant described herein comprises (i) the amino acid sequence of HDSPHSKA (SEQ ID NO: 4486), which is present immediately subsequent to position 453; and (ii) a deletion of amino acids SG at position 454 and 455; wherein (i) and (ii) are numbered according to SEQ ID NO: 138.

In some embodiments, an AAV capsid variant described herein comprises an amino acid other than S at position 454 and/or an amino acid other than G at position 455, numbered according to SEQ ID NO: 138. In some embodiments, the AAV capsid variant comprises the amino acid H at position 454 and the amino acid D at position 455, numbered according to SEQ ID NO: 138. In some embodiments, the AAV capsid variant further comprises the amino acid sequence of SPHSKA (SEQ ID NO: 941). In some embodiments, the AAV capsid variant comprises: (i) the amino acid H at position 454 and the amino acid D at position 455, and (ii) the amino acid sequence SPHSKA (SEQ ID NO: 941), wherein the amino acid sequence of SPHKSG (SEQ ID NO: 946) is present immediately subsequent to position 455, wherein (i) and (ii) are numbered according to SEQ ID NO: 138.

In some embodiments, an AAV capsid variant described herein comprises a modification, e.g., substitution, relative to SEQ ID NO: 138. In some embodiments, the AAV capsid variant comprises a modification, e.g., substitution, at position S454 and/or G455, numbered relative to SEQ ID NO: 138. In some embodiments, the AAV capsid variant comprises a S454H substitution and/or G455D substitution, numbered relative to SEQ ID NO: 138. In some embodiments, the AAV capsid variant comprises a S454H substitution and a G455D substitution, numbered relative to SEQ ID NO: 138. In some embodiments, the AAV capsid variant further comprises the amino acid sequence of SPHSKA (SEQ ID NO: 941). In some embodiments, the AAV capsid variant comprises: (i) a S454H substitution and a G455D substitution, and (ii) the amino acid sequence SPHKSG (SEQ ID NO: 946), wherein the amino acid sequence of SPHSKA (SEQ ID NO: 941) is present immediately subsequent to position 455, wherein (i) and (ii) are numbered according to SEQ ID NO: 138.

In some embodiments, the AAV capsid variant further comprises one, two, or all of an amino acid other than T at position 450 (e.g., S, Y, or G), an amino acid other than I at position 451 (e.g., M or L), and/or an amino acid other than N at position 452 (e.g., S), relative to a reference sequence numbered according to the amino acid sequence of SEQ ID NO: 138. In some embodiments, the AAV capsid variant further comprises an S at position 450 and an M at position 451, relative to a reference sequence numbered according to the amino acid sequence of SEQ ID NO: 138. In some embodiments, the AAV capsid variant further comprises a Y at position 450, an L at position 451, and an S at position 452, relative to a reference sequence numbered according to the amino acid sequence of SEQ ID NO: 138. In some embodiments, the AAV capsid variant further comprises a G at position 450, an L at position 451, and an S at position 452, relative to a reference sequence numbered according to the amino acid sequence of SEQ ID NO: 138.

In some embodiments, the AAV capsid variant further comprises one, two, three, four, or all of an amino acid other than Q at position 456 (e.g., R or L), N at position 457 (e.g., H, K, or R), Q at position 458 (e.g., R or T), Q at position 459 (H), and/or T at position 460 (N or S), relative to a reference sequence numbered according to the amino acid sequence of SEQ ID NO: 138. In some embodiments, the AAV capsid variant further comprises an R at position 456, relative to a reference sequence numbered according to the amino acid sequence of SEQ ID NO: 138. In some embodiments, the AAV capsid variant further comprises an L at position 456, relative to a reference sequence numbered according to the amino acid sequence of SEQ ID NO: 138. In some embodiments, the AAV capsid variant further comprises an H at position 457 and an R at position 458, relative to a reference sequence numbered according to the amino acid sequence of SEQ ID NO: 138. In some embodiments, the AAV capsid variant further comprises a K at position 457 and an N at position 460, relative to a reference sequence numbered according to the amino acid sequence of SEQ ID NO: 138. In some embodiments, the AAV capsid variant further comprises a T at position 458, an H at position 459, and an S at position 460, relative to a reference sequence numbered according to the amino acid sequence of SEQ ID NO: 138. In some embodiments, the AAV capsid variant further comprises an R at position 456, an R at position 457, and an R at position 458, relative to a reference sequence numbered according to the amino acid sequence of SEQ ID NO: 138.

In some embodiments, an AAV capsid variant described herein comprises an amino acid other than I at position 451, an amino acid other than N at position 452, and an amino acid other than G at position 453, numbered according to SEQ ID NO: 138 or 981. In some embodiments, the AAV capsid variant comprises E at position 451, R at position 452, and V at position 453, numbered according to SEQ ID NO: 138 or 981. In some embodiments, the AAV capsid variant comprises the substitutions I451E, N452R, and G453V, numbered according to SEQ ID NO: 138 or 981.

In some embodiments, the AAV capsid variant comprises the amino acid sequence of SPHSKA (SEQ ID NO: 941), wherein the amino acid sequence is present immediately subsequent to position 455 and wherein the AAV capsid variant comprises the E at position 451, R at position 452, and V at position 453, numbered according to the amino acid sequence of SEQ ID NO: 138 or 981. In some embodiments, the AAV capsid variant comprises the substitutions I451E, N452R, and G453V, and further comprises the amino acid sequence of SPHSKA (SEQ ID NO: 941), wherein the amino acid sequence is present immediately subsequent to position 455, all numbered according to SEQ ID NO: 138 or 981. In some embodiments, the AAV capsid variant comprises the amino acid sequence of ERVSGSPHSKA (SEQ ID NO: 6399), and wherein the amino acid sequence is present immediately subsequent to position 449 and replaces positions 450-455, numbered according to SEQ ID NO: 138. In some embodiments, the AAV capsid variant comprises the amino acid sequence of KTERVSGSPHSKAQNQQT (SEQ ID NO: 3589), wherein the amino acid sequence is present immediately subsequent to position 448 and replaces positions 449-460, numbered according to SEQ ID NO: 138.

In some embodiments, an AAV capsid variant described herein comprises an amino acid other than T at position 450, an amino acid other than I at position 451, and an amino acid other than N at position 452, numbered according to SEQ ID NO: 138 or 982. In some embodiments, the AAV capsid variant comprises A at position 450, E at position 451, and I at position 452, numbered according to SEQ ID NO: 138 or 982. In some embodiments, the AAV capsid variant comprises the substitutions T450A, I451E, and N452I, numbered according to SEQ ID NO: 138 or 982.

In some embodiments, the AAV capsid variant comprises the amino acid sequence of HDSPHK (SEQ ID NO: 2), which is present immediately subsequent to positions 453, and further comprises A at position 450, E at position 451, and I at position 452, all numbered according to SEQ ID NO: 138 or 982. In some embodiments, the AAV capsid variant comprises the substitutions T450A, I451E, and N452I, and further comprises the amino acid sequence HDSPHK (SEQ ID NO: 2) present immediately subsequent to position 453, all numbered according to SEQ ID NO: 138 or 982. In some embodiments, the AAV capsid variant comprises the amino acid sequence of AEIGHDSPHKSG (SEQ ID NO: 6400), wherein the amino acid sequence is present immediately subsequent to position 449 and replaces positions 450-455, numbered according to SEQ ID NO: 138. In some embodiments, the AAV capsid variant comprises the amino acid sequence of KAEIGHDSPHKSGQNQQT (SEQ ID NO: 1754), wherein the amino acid sequence is present immediately subsequent to position 448 and replaces positions 449-460, numbered according to SEQ ID NO: 138.

In some embodiments, the AAV capsid variant, further comprises a substitution at position K449, e.g., a K449R substitution, numbered according to SEQ ID NO: 138. In some embodiments, the AAV capsid variant, further comprises an amino acid other than K at position 449 (e.g., R), relative to a reference sequence numbered according to the amino acid sequence of SEQ ID NO: 138. In some embodiments, the AAV capsid variant comprises an R at position 449, relative to a reference sequence numbered according to the amino acid sequence of SEQ ID NO: 138. In some embodiments, the AAV capsid variant further comprises a modification, e.g., an insertion, substitution, and/or deletion in loop I, II, VI, and/or VIII.

In some embodiments, the AAV capsid variant, further comprises an amino acid sequence comprising at least one, two or three modifications, e.g., substitutions (e.g., conservative substitutions), insertions, or deletions, but not more than 30, 20 or 10 modifications, e.g., substitutions (e.g., conservative substitutions), insertions, or deletions, of the amino acid sequence of SEQ ID NO: 138. In some embodiments, the AAV capsid variant, further comprises an amino acid sequence comprising at least one, two or three, but not more than 30, 20 or 10 amino acids that differ from the amino acid sequence of SEQ ID NO: 138. In some embodiments, the AAV capsid variant further comprises the amino acid sequence of SEQ ID NO: 138, or an amino acid sequence with at least 70% (e.g., at least about 80, 85, 90, 95, 96, 97, 98, or 99%) sequence identity thereto.

In some embodiments, the AAV capsid variant further comprises (a) a VP1 protein comprising the amino acid sequence of SEQ ID NO: 138, 981, or 982; (b) a VP2 protein comprising the amino acid sequence of positions 138-736 of SEQ ID NO: 138 or positions 138-742 of SEQ ID NO: 981 or 982; (c) a VP3 protein comprising the amino acid sequence of positions 203-736 of SEQ ID NO: 138 or positions 203-742 of SEQ ID NO: 981 or 982; or (d) an amino acid sequence with at least 70% (e.g., at least about 80, 85, 90, 95, 96, 97, 98, or 99%) sequence identity to any of the amino acid sequences in (a)-(c), an amino acid sequence comprising at least one, two or three, but not more than 30, 20 or 10 different amino acids relative to any of the amino acid sequences in (a)-(c), or an amino acid sequence comprising at least one, two or three modifications, e.g., substitutions (e.g., conservative substitutions), insertions, or deletions, but not more than 30, 20 or 10 modifications, e.g., substitutions (e.g., conservative substitutions), insertions, or deletions, relative to any of the amino acid sequences in (a)-(c).

In some embodiments, the AAV capsid variant further comprises an amino acid sequence encoded by the nucleotide sequence of SEQ ID NO: 137, or a sequence with at least 70% (e.g., at least about 80, 85, 90, 95, 96, 97, 98, or 99%) sequence identity thereto. In some embodiments, the AAV capsid variant further comprises an amino acid sequence encoded by a nucleotide sequence comprising at least one, two or three modifications, e.g., substitutions (e.g., conservative substitutions), insertions, or deletions, but not more than 30, 20 or 10 modifications, e.g., substitutions (e.g., conservative substitutions), insertions, or deletions, relative to the nucleotide sequence of SEQ ID NO: 137. In some embodiments, the AAV capsid variant further comprises an amino acid sequence encoded by a nucleotide sequence comprising at least one, two or three, but not more than 30, 20 or 10 different nucleotides, relative to the amino acid sequence of SEQ ID NO: 137.

In some embodiments, the nucleotide sequence encoding the AAV capsid variant further comprises the nucleotide sequence of SEQ ID NO: 137, or a sequence with at least 70% (e.g., at least about 80, 85, 90, 95, 96, 97, 98, or 99%) sequence identity thereto. In some embodiments, the nucleotide sequence encoding the AAV capsid variant further comprises a nucleotide sequence comprising at least one, two or three modifications, e.g., substitutions (e.g., conservative substitutions), insertions, or deletions, but not more than 30, 20 or 10 modifications, e.g., substitutions (e.g., conservative substitutions), insertions, or deletions, relative to the nucleotide sequence of SEQ ID NO: 137. In some embodiments, the nucleotide sequence encoding the AAV capsid variant further comprises a nucleotide sequence comprising at least one, two or three, but not more than 30, 20 or 10 different nucleotides, relative to the amino acid sequence of SEQ ID NO: 137.

In some embodiments, an AAV capsid variant of the present disclosure comprises an amino acid sequence as described herein, e.g., an amino acid sequence of an AAV capsid variant of TTM-001 or TTM-002, e.g., as described in Tables 3 and 4. In some embodiments, an AAV capsid variant of the present disclosure comprises an amino acid sequence as described herein, e.g., an amino acid sequence of an AAV capsid variant of TTM-003, TTM-004, TTM-005, TTM-006, TTM-007, TTM-008, TTM-009, TTM-010, TTM-011, TTM-012, TTM-013, TTM-014, TTM-015, TTM-016, TTM-017, TTM-018, TTM-019, TTM-020, TTM-021, TTM-022, TTM-023, TTM-024, TTM-025, or TTM-026, e.g., as described in Table 4.

In some embodiments, an AAV capsid variant described herein comprises a VP1, VP2, and/or VP3 protein comprising an amino acid sequence described herein, e.g., an amino acid sequence of an AAV capsid variant of TTM-001 or TTM-002, e.g., as described in Tables 3 and 4. In some embodiments, an AAV capsid variant described herein comprises a VP1, VP2, and/or VP3 protein comprising an amino acid sequence described herein, e.g., an amino acid sequence of an AAV capsid variant of TTM-003, TTM-004, TTM-005, TTM-006, TTM-007, TTM-008, TTM-009, TTM-010, TTM-011, TTM-012, TTM-013, TTM-014, TTM-015, TTM-016, TTM-017, TTM-018, TTM-019, TTM-020, TTM-021, TTM-022, TTM-023, TTM-024, TTM-025, or TTM-026, e.g., as described in Table 4.

In some embodiments, an AAV capsid variant described herein comprises an amino acid sequence encoded by a nucleotide sequence as described herein, e.g., a nucleotide sequence of an AAV capsid variant of TTM-001 or TTM-002, e.g., as described in Tables 3 and 5. In some embodiments, an AAV capsid variant described herein comprises an amino acid sequence encoded by a nucleotide sequence as described herein, e.g., a nucleotide sequence of an AAV capsid variant of TTM-003, TTM-004, TTM-005, TTM-006, TTM-007, TTM-008, TTM-009, TTM-010, TTM-011, TTM-012, TTM-013, TTM-014, TTM-015, TTM-016, TTM-017, TTM-018, TTM-019, TTM-020, TTM-021, TTM-022, TTM-023, TTM-024, TTM-025, or TTM-026, e.g., as described in Table 5.

In some embodiments, a polynucleotide or nucleic acid encoding an AAV capsid variant, of the present disclosure comprises a nucleotide sequence described herein, e.g., a nucleotide sequence of an AAV capsid variant of TTM-001 or TTM-002, e.g., as described in Tables 3 and 5. In some embodiments, a polynucleotide or nucleic acid encoding an AAV capsid variant, of the present disclosure comprises a nucleotide sequence described herein, e.g., a nucleotide sequence of an AAV capsid variant of TTM-003, TTM-004, TTM-005, TTM-006, TTM-007, TTM-008, TTM-009, TTM-010, TTM-011, TTM-012, TTM-013, TTM-014, TTM-015, TTM-016, TTM-017, TTM-018, TTM-019, TTM-020, TTM-021, TTM-022, TTM-023, TTM-024, TTM-025, or TTM-026, e.g., as described in Table 5.

TABLE 3

Exemplary full length capsid sequences

| Name | VP1 DNA SEQ ID NO: | VP1 (amino acid) SEQ ID NO: | Peptide (amino acid) SEQ ID NO: | Peptide DNA SEQ ID NO: |
| --- | --- | --- | --- | --- |
| TTM-001 | 983 | 981 | 941 | 942 |
| TTM-002 | 984 | 982 | 2 | 3 |

TABLE 4

Exemplary full length capsid amino acid sequences

| Name and Annotation | SEQ ID NO: | Amino Acid Sequence |
| --- | --- | --- |
| TTM-001 6mer peptide underlined, starts at position 456 (immediately subsequent to position 455); 742 aa | 981 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVEMIPQYGYLTLNDGSQAVGRS SFYCLEYFPSQMLRTGNNFQFSYEFENVPFHSSYAHSQSLDRLMNPLIDQYLYYLS KTINGSGSPHSKAQNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-002 6mer peptide underlined, starts at position 454 (immediately subsequent to position 453); 742 aa | 982 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVEMIPQYGYLTLNDGSQAVGRS SFYCLEYFPSQMLRTGNNFQFSYEFENVPFHSSYAHSQSLDRLMNPLIDQYLYYLS KTINGHDSPHKSGQNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR |

TABLE 4-continued

Exemplary full length capsid amino acid sequences

| Name and Annotation | SEQ ID NO: | Amino Acid Sequence |
|---|---|---|
| | | DVYLQGPIWAKIPHTDGNFHPSPLMGGFGMKHPPPQILIKNTPVPADPPTAFNKDK<br>LNSFITQYSTGQVSVEIEWELQKENSKRWNPEIQYTSNYYKSNNVEFAVNTEGVYS<br>EPRPIGTRYLTRNL |
| TTM-003<br>6mer peptide underlined,<br>starts at position 456 (immediately subsequent to position 455);<br>modifications at positions 451, 452, and 453 underlined;<br>742 aa | 36 | MAADGYLPDWLEDNLSEGIREWWALKPGAPQPKANQQHQDNARGLVLPGYKYLGPG<br>NGLDKGEPVNAADAAALEHDKAYDQQLKAGDNPYLKYNHADAEFQERLKEDTSFGG<br>NLGRAVFQAKKRLLEPLGLVEEAAKTAPGKKRPVEQSPQEPDSSAGIGKSGAQPAK<br>KRLNFGQTGDTESVPDPQPIGEPPAAPSGVGSLTMASGGGAPVADNNEGADGVGSS<br>SGNWHCDSQWLGDRVITTSTRTWALPTYNNHLYKQISNSTSGGSSNDNAYFGYSTP<br>WGYFDFNRFHCHFSPRDWQRLINNNWGFRPKRLNFKLFNIQVKEVTDNNGVKTIAN<br>NLTSTVQVFTDSDYQLPYVLGSAHEGCLPPFPADVEMIPQYGYLTLNDGSQAVGRS<br>SFYCLEYFPSQMLRTGNNFQFSYEFENVPFHSSYAHSQSLDRLMNPLIDQYLYYLS<br>KTERVSGSPHSKAQNQQTLKFSVAGPSNMAVQGRNYIPGPSYRQQRVSTTVTQNNN<br>SEFAWPGASSWALNGRNSLMNPGPAMASHKEGEDRFFPLSGSLIFGKQGTGRDNVD<br>ADKVMITNEEEIKTTNPVATESYGQVATNHQSAQAQTGWVQNQGILPGMVWQDR<br>DVYLQGPIWAKIPHTDGNFHPSPLMGGFGMKHPPPQILIKNTPVPADPPTAFNKDK<br>LNSFITQYSTGQVSVEIEWELQKENSKRWNPEIQYTSNYYKSNNVEFAVNTEGVYS<br>EPRPIGTRYLTRNL |
| TTM-004<br>6mer peptide underlined,<br>starts at position 454 (immediately subsequent to position 453);<br>modifications at positions 450, 451, and 452 underlined;<br>742 aa | 37 | MAADGYLPDWLEDNLSEGIREWWALKPGAPQPKANQQHQDNARGLVLPGYKYLGPG<br>NGLDKGEPVNAADAAALEHDKAYDQQLKAGDNPYLKYNHADAEFQERLKEDTSFGG<br>NLGRAVFQAKKRLLEPLGLVEEAAKTAPGKKRPVEQSPQEPDSSAGIGKSGAQPAK<br>KRLNFGQTGDTESVPDPQPIGEPPAAPSGVGSLTMASGGGAPVADNNEGADGVGSS<br>SGNWHCDSQWLGDRVITTSTRTWALPTYNNHLYKQISNSTSGGSSNDNAYFGYSTP<br>WGYFDFNRFHCHFSPRDWQRLINNNWGFRPKRLNFKLFNIQVKEVTDNNGVKTIAN<br>NLTSTVQVFTDSDYQLPYVLGSAHEGCLPPFPADVFMIPQYGYLTLNDGSQAVGRS<br>SFYCLEYFPSQMLRTGNNFQFSYEFENVPFHSSYAHSQSLDRLMNPLIDQYLYYLS<br>KAEIGHDSPHKSGQNQQTLKFSVAGPSNMAVQGRNYIPGPSYRQQRVSTTVTQNNN<br>SEFAWPGASSWALNGRNSLMNPGPAMASHKEGEDRFFPLSGSLIFGKQGTGRDNVD<br>ADKVMITNEEEIKTTNPVATESYGQVATNHQSAQAQTGWVQNQGILPGMVWQDR<br>DVYLQGPIWAKIPHTDGNFHPSPLMGGFGMKHPPPQILIKNTPVPADPPTAFNKDK<br>LNSLITQYSTGQVSVEIEWELQKENSKRWNPEIQYTSNYYKSNNVEFAVNTEGVYS<br>EPRPIGTRYLTRNL |
| TTM-005<br>6mer peptide underlined,<br>starts at position 456 (immediately subsequent to position 455);<br>modifications at positions 452, 464, and 465 underlined;<br>742 aa | 38 | MAADGYLPDWLEDNLSEGIREWWALKPGAPQPKANQQHQDNARGLVLPGYKYLGPG<br>NGLDKGEPVNAADAAALEHDKAYDQQLKAGDNPYLKYNHADAEFQERLKEDTSFGG<br>NLGRAVFQAKKRLLEPLGLVEEAAKTAPGKKRPVEQSPQEPDSSAGIGKSGAQPAK<br>KRLNFGQTGDTESVPDPQPIGEPPAAPSGVGSLTMASGGGAPVADNNEGADGVGSS<br>SGNWHCDSQWLGDRVITTSTRTWALPTYNNHLYKQISNSTSGGSSNDNAYFGYSTP<br>WGYFDFNRFHCHFSPRDWQRLINNNWGFRPKRLNFKLFNIQVKEVTDNNGVKTIAN<br>NLTSTVQVFTDSDYQLPYVLGSAHEGCLPPFPADVFMIPQYGYLTLNDGSQAVGRS<br>SFYCLEYFPSQMLRTGNNFQFSYEFENVPFHSSYAHSQSLDRLMNPLIDQYLYYLS<br>KTIIGSSPHSKAQNRHTLKFSVAGPSNMAVQGRNYIPGPSYRQQRVSTTVTQNNN<br>SEFAWPGASSWALNGRNSLMNPGPAMASHKEGEDRFFPLSGSLIFGKQGTGRDNVD<br>ADKVMITNEEEIKTTNPVATESYGQVATNHQSAQAQTGWVQNQGILPGMVWQDR<br>DVYLQGPIWAKIPHTDGNFHPSPLMGGFGMKHPPPQILIKNTPVPADPPTAFNKDK<br>LNSFITQYSTGQVSVEIEWELQKENSKRWNPEIQYTSNYYKSNNVEFAVNTEGVYS<br>EPRPIGTRYLTRNL |
| TTM-006<br>6mer peptide underlined,<br>starts at position 456 (immediately subsequent to position 455);<br>modifications at positions 451, 452, and 453 underlined;<br>742 aa | 39 | MAADGYLPDWLEDNLSEGIREWWALKPGAPQPKANQQHQDNARGLVLPGYKYLGPG<br>NGLDKGEPVNAADAAALEHDKAYDQQLKAGDNPYLKYNHADAEFQERLKEDTSFGG<br>NLGRAVFQAKKRLLEPLGLVEEAAKTAPGKKRPVEQSPQEPDSSAGIGKSGAQPAK<br>KRLNFGQTGDTESVPDPQPIGEPPAAPSGVGSLTMASGGGAPVADNNEGADGVGSS<br>SGNWHCDSQWLGDRVITTSTRTWALPTYNNHLYKQISNSTSGGSSNDNAYFGYSTP<br>WGYFDFNRFHCHFSPRDWQRLINNNWGFRPKRLNFKLFNIQVKEVTDNNGVKTIAN<br>NLTSTVQVFTDSDYQLPYVLGSAHEGCLPPFPADVFMIPQYGYLTLNDGSQAVGRS<br>SFYCLEYFPSQMLRTGNNFQFSYEFENVPFHSSYAHSQSLDRLMNPLIDQYLYYLS<br>KTEKMSGSPHSKAQNQQTLKFSVAGPSNMAVQGRNYIPGPSYRQQRVSTTVTQNNN<br>SEFAWPGASSWALNGRNSLMNPGPAMASHKEGEDRFFPLSGSLIFGKQGTGRDNVD<br>ADKVMITNEEEIKTTNPVATESYGQVATNHQSAQAQTGWVQNQGILPGMVWQDR<br>DVYLQGPIWAKIPHTDGNFHPSPLMGGFGMKHPPPQILIKNTPVPADPPTAFNKDK<br>LNSFITQYSTGQVSVEIEWELQKENSKRWNPEIQYTSNYYKSNNVEFAVNTEGVYS<br>EPRPIGTRYLTRNL |
| TTM-007<br>6mer peptide underlined,<br>starts at position 456 (immediately subsequent to position 455);<br>modifications at positions 450 | 40 | MAADGYLPDWLEDNLSEGIREWWALKPGAPQPKANQQHQDNARGLVLPGYKYLGPG<br>NGLDKGEPVNAADAAALEHDKAYDQQLKAGDNPYLKYNHADAEFQERLKEDTSFGG<br>NLGRAVFQAKKRLLEPLGLVEEAAKTAPGKKRPVEQSPQEPDSSAGIGKSGAQPAK<br>KRLNFGQTGDTESVPDPQPIGEPPAAPSGVGSLTMASGGGAPVADNNEGADGVGSS<br>SGNWHCDSQWLGDRVITTSTRTWALPTYNNHLYKQISNSTSGGSSNDNAYFGYSTP<br>WGYFDFNRFHCHFSPRDWQRLINNNWGFRPKRLNFKLFNIQVKEVTDNNGVKTIAN<br>NLTSTVQVFTDSDYQLPYVLGSAHEGCLPPFPADVFMIPQYGYLTLNDGSQAVGRS<br>SFYCLEYFPSQMLRTGNNFQFSYEFENVPFHSSYAHSQSLDRLMNPLIDQYLYYLS<br>KEINGRGSPHSKAQNQQTLKFSVAGPSNMAVQGRNYIPGPSYRQQRVSTTVTQNNN<br>SEFAWPGASSWALNGRNSLMNPGPAMASHKEGEDRFFPLSGSLIFGKQGTGRDNVD |

TABLE 4-continued

Exemplary full length capsid amino acid sequences

| Name and Annotation | SEQ ID NO: | Amino Acid Sequence |
|---|---|---|
| and 454 underlined; 742 aa | | ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-008 6mer peptide underlined, starts at position 456 (immediately subsequent to position 455); modifications at positions 451, 462, and 464 underlined; 742 aa | 41 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVEMIPQYGYLTLNDGSQAVGRS SFYCLEYFPSQMLRTGNNFQFSYEFENVPFHSSYAHSQSLDRLMNPLIDQYLYYLS KTFNGSGSPHSKAPNLQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-009 6mer peptide underlined, starts at position 456 (immediately subsequent to position 455); modifications at positions 451, 452, and 453 underlined; 742 aa | 42 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTEKTSGSPHSKAQNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-010 6mer peptide underlined, starts at position 456 (immediately subsequent to position 455); modifications at positions 451, 454, and 455 underlined; 742 aa | 43 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTMNGHDSPHSKAQNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-011 6mer peptide underlined, starts at position 456 (immediately subsequent to position 455); modifications at positions 452, 454, and 455 underlined; 742 aa | 44 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTIDGHDSPHSKA**QNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-012 6mer peptide underlined, starts at position 456 (immediately subsequent to position 455); modifications at | 45 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTNNGHDSPHSKA**QNQQTLKFSVAGPSNMAVQGRNYIPGPSYRQQRVSTTVTQNNN |

US 12,296,025 B2

243                                                                244

TABLE 4-continued

Exemplary full length capsid amino acid sequences

| Name and Annotation | SEQ ID NO: | Amino Acid Sequence |
|---|---|---|
| positions 452, 454, and 455 underlined; 742 aa | | SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-013 6mer peptide underlined, starts at position 456 (immediately subsequent to position 455); modifications at positions 451, 452, and 453 underlined; 742 aa | 46 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVEMIPQYGYLTLNDGSQAVGRS SFYCLEYFPSQMLRTGNNFQFSYEFENVPFHSSYAHSQSLDRLMNPLIDQYLYYLS KTQRKSGSPHSKAQNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-014 6mer peptide underlined, starts at position 456 (immediately subsequent to position 455); modifications at positions 463, 464, and 465 underlined; 742 aa | 47 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVEMIPQYGYLTLNDGSQAVGRS SFYCLEYFPSQMLRTGNNFQFSYEFENVPFHSSYAHSQSLDRLMNPLIDQYLYYLS KTINGSGSPHSKAQARKTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-015 6mer peptide underlined, starts at position 456 (immediately subsequent to position 455); modifications at positions 450 and 452 underlined; 742 aa | 48 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KYIVGSGSPHSKAQNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAENKDK LNSFITQYSTGQVSVEIEWELQKENSKRWNPEIQYTSNYYKSNNVEFAVNTEGVYS EPRPIGTRYLTRNL |
| TTM-016 6mer peptide underlined, starts at position 456 (immediately subsequent to position 455); modifications at positions 452, 453, and 454 underlined; 742 aa | 49 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTISKRGSPHSKA**QNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-017 6mer peptide underlined, starts at position 456 (immediately subsequent to position 455); | 50 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS |

TABLE 4-continued

Exemplary full length capsid amino acid sequences

| Name and Annotation | SEQ ID NO: | Amino Acid Sequence |
|---|---|---|
| modifications at positions 450, 451, and 452 underlined; 742 aa | | KGLGGSGSPHSKAQNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAENKDK LNSFITQYSTGQVSVEIEWELQKENSKRWNPEIQYTSNYYKSNNVEFAVNTEGVYS EPRPIGTRYLTRNL |
| TTM-018 6mer peptide underlined, starts at position 456 (immediately subsequent to position 455); modifications at positions 454, 455, and 464 underlined; 742 aa | 51 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTINGHDSPHSKAQNLQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-019 6mer peptide underlined, starts at position 456 (immediately subsequent to position 455); modifications at positions 451, 454, and 455 underlined; 742 aa | 52 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTVNGHDSPHSKAQNQQTLKFSVAGPSNMAVQGRNYIPGPSYRQQRVSTTVTQNNN SEF**AWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAENKDK LNSFITQYSTGQVSVEIEWELQKENSKRWNPEIQYTSNYYKSNNVEFAVNTEGVYS EPRPIGTRYLTRNL |
| TTM-020 6mer peptide underlined, starts at position 456 (immediately subsequent to position 455); modifications at positions 454, 455, and 462 underlined; 742 aa | 53 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTINGHDSPHSKALNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAENKDK LNSFITQYSTGQVSVEIEWELQKENSKRWNPEIQYTSNYYKSNNVEFAVNTEGVYS EPRPIGTRYLTRNL |
| TTM-021 6mer peptide underlined, starts at position 456 (immediately subsequent to position 455); modifications at positions 454, 455, and 466 underlined; 742 aa | 54 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTINGHDSPHSKAQNQQSLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-022 6mer peptide underlined, starts at position 456 (immediately subsequent to | 55 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS |

TABLE 4-continued

Exemplary full length capsid amino acid sequences

| Name and Annotation | SEQ ID NO: | Amino Acid Sequence |
|---|---|---|
| position 455); modifications at positions 454, 455, and 466 underlined; 742 aa | | SFYCLEYFPSQMLRTGNNFQFSYEFENVPFHSSYAHSQSLDRLMNPLIDQYLYYLS KTINGHDSPHSKAQNQQILKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAENKDK LNSFITQYSTGQVSVEIEWELQKENSKRWNPEIQYTSNYYKSNNVEFAVNTEGVYS EPRPIGTRYLTRNL |
| TTM-023 6mer peptide underlined, starts at position 456 (immediately subsequent to position 455); 742 aa | 56 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVEMIPQYGYLTLNDGSQAVGRS SFYCLEYFPSQMLRTGNNFQFSYEFENVPFHSSYAHSQSLDRLMNPLIDQYLYYLS KTINGSGSPHFTRQNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-024 6mer peptide underlined, starts at position 456 (immediately subsequent to position 455); modifications at positions 451, 454, and 455 underlined; 742 aa | 57 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTSNGHDSPHSKA**QNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-025 6mer peptide underlined, starts at position 456 (immediately subsequent to position 455); modification at position 462 underlined; 742 aa | 58 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTINGSGSPHSLPWNQQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |
| TTM-026 6mer peptide underlined, starts at position 456 (immediately subsequent to position 455); modification at positions 454, 455, and 464 underlined; 742 aa | 59 | MAADGYLPDWLEDNLSEGIREWWALKPGAPQPKANQQHQDNARGLVLPGYKYLGPG NGLDKGEPVNAADAAALEHDKAYDQQLKAGDNPYLKYNHADAEFQERLKEDTSFGG NLGRAVFQAKKRLLEPLGLVEEAAKTAPGKKRPVEQSPQEPDSSAGIGKSGAQPAK KRLNFGQTGDTESVPDPQPIGEPPAAPSGVGSLTMASGGGAPVADNNEGADGVGSS SGNWHCDSQWLGDRVITTSTRTWALPTYNNHLYKQISNSTSGGSSNDNAYFGYSTP WGYFDFNRFHCHFSPRDWQRLINNNWGFRPKRLNFKLFNIQVKEVTDNNGVKTIAN NLTSTVQVFTDSDYQLPYVLGSAHEGCLPPFPADVFMIPQYGYLTLNDGSQAVGRS SFYCLEYFPSQMLRTGNNFQFSYEFENVPFHSSYAHSQSLDRLMNPLIDQYLYYLS KTINGHDSPHSKAQNHQTLKFSVAGPSNMAVQGRNYIPGPSYRQQRVSTTVTQNNN SEFAWPGASSWALNGRNSLMNPGPAMASHKEGEDRFFPLSGSLIFGKQGTGRDNVD ADKVMITNEEEIKTTNPVATESYGQVATNHQSAQAQAQTGWVQNQGILPGMVWQDR DVYLQGPIWAKIPHTDGNFHPSPLMGGFGMKHPPPQILIKNTPVPADPPTAFNKDK LNSFITQYSTGQVSVEIEWELQKENSKRWNPEIQYTSNYYKSNNVEFAVNTEGVYS EPRPIGTRYLTRNL |

TABLE 5

Exemplary full length capsid nucleic acid sequences

| Name and Annotation | SEQ ID NO: | NT Sequence |
|---|---|---|
| TTM-001 9mer peptide underlined | 983 | ATGGCTGCCGATGGTTATCTTCCAGattggcTCGAGGACAACCTTAGTGAAGGAAT TCGCGAGTGGTGGGCTTTGAAACCTGGAGCCCCTCAACCCAAGGCAAATCAACAAC ATCAAGACAACGCTCGAGGTCTTGTGCTTCCGGGTTACAAATACCTTGGACCCGGC AACGGACTCGACAAGGGGGAGCCGGTCAACGCAGCAGACGCGGCGGCCCTCGAGCA CGACAAGGCCTACGACCAGCAGCTCAAGGCCGGAGACAACCCGTACCTCAAGTACA ACCACGCCGACGCCGAGTTCCAGGAGCGGCTCAAAGAAGATACGTCTTTTGGGGGC AACCTCGGGCGAGCAGTCTTCCAGGCCAAAAAGAGGCTTCTTGAACCTCTTGGTCT GGTTGAGGAAGCGGCTAAGACGGCTCCTGGAAAGAAGAGGCCTGTAGAGCAGTCTC CTCAGGAACCGGACTCCTCCGCGGGTATTGGCAAATCGGGTGCACAGCCCGCTAAA AAGAGACTCAATTTCGGTCAGACTGGCGACACAGAGTCAGTCCCAGACCCTCAACC AATCGGAGAACCTCCCGCAGCCCCCTCAGGTGTGGGATCTCTTACAATGGCTTCAG GTGGTGGCGCACCAGTGGCAGACAATAACGAAGGTGCCGATGGAGTGGGTAGTTCC TCGGGAAATTGGCATTGCGATTCCCAATGGCTGGGGACAGAGTCATCACCACCAG CACCCGAACCTGGGCCCTGCCCACCTACAACAATCACCTCTACAAGCAAATCTCCA ACAGCACATCTGGAGGATCTTCAAATGACAACGCCTACTTCGGCTACAGCACCCCC TGGGGGTATTTTGACTTCAACAGATTCCACTGCCACTTCTCACCACGTGACTGGCA GCGACTCATCAACAACAACTGGGGATTCCGGCCTAAGCGACTCAACTTCAAGCTCT TCAACATTCAGGTCAAAGAGGTTACGGACAACAATGGAGTCAAGACCATCGCCAAT AACCTTACCAGCACGGTCCAGGTCTTCACGGACTCAGACTATCAGCTCCCGTACGT GCTCGGGTCGGCTCACGAGGGCTGCCTCCCGCCGTTCCCAGCGGACGTTTTCATGA TTCCTCAGTACGGGTATCTGACGCTTAATGATGGAAGCCAGGCCGTGGGTCGTTCG TCCTTTTACTGCCTGGAATATTTCCCGTCGCAAATGCTAAGAACGGGTAACAACTT CCAGTTCAGCTACGAGTTTGAGAACGTACCTTTCCATAGCAGCTACGCTCACAGCC AAAGCCTGGACCGACTAATGAATCCACTCATCGACCAATACTTGTAtTActTgagt AAaACaATTAACGGAAGCGGAAGCCCACACAGCAAAGCACAAAACCAACAGACCtT gAAgTTttcgGTaGCtGGtCCtAGCAACATGGCTGTCCAGGGAAGAAACTACATAC CTGGACCCAGCTACCGACAACAACGTGTCTCAACCACTGTGACTCAAAACAACAAC AGCGAATTTGCTTGGCCTGGAGCTTCTTCTTGGGCTCTCAATGGACGTAATAGCTT GATGAATCCTGGACCTGCTATGGCCAGCCACAAAGAAGGAGAGGACCGTTTCTTTC CTTTGTCTGGATCTTTAATTTTTGGCAAACAAGGAACTGGAAGAGACAACGTGGAT GCGGACAAAGTCATGATAACCAACGAAGAAGAAATTAAAACTACTAACCCGGTAGC AACGGAGTCCTATGGACAAGtggccacaaaccaccagagtGCCCAAGCACAGGCGC AGaccggctgggttcaaaaccaAGGAATACTTCCGGGTATGGTTTGGCAGGACAGA GATGTGTACCTGCAAGGACCCATTTGGGCCAAAATTCCTCACACGGACGGCAACTT TCACCCTTCTCCGCTGATGGGAGGGTTTGGAATGAAGCACCCGCCTCCTCAGATCC TCATCAAAAACACACCTGTACCTGCGGATCCTCCAACGGCCTTCAACAAGGACAAG CTGAACTCTTTCATCACCCAGTATTCTACTGGCCAAGTCAGCGTGGAGATCGAGTG GGAGCTGCAGAAGGAAAACAGCAAGCGCTGGAACCCGGAGATCCAGTACACTTCCA ACTATTACAAGTCTAATAATGTTGAATTTGCTGTTAATACTGAAGGTGTATATAGT GAACCCCGCCCCATTGGCACGcGgTAttTAACgaGgAActTaTAA |
| TTM-002 7mer peptide underlined | 984 | ATGGCTGCCGATGGTTATCTTCCAGattggcTCGAGGACAACCTTAGTGAAGGAAT TCGCGAGTGGTGGGCTTTGAAACCTGGAGCCCCTCAACCCAAGGCAAATCAACAAC ATCAAGACAACGCTCGAGGTCTTGTGCTTCCGGGTTACAAATACCTTGGACCCGGC AACGGACTCGACAAGGGGGAGCCGGTCAACGCAGCAGACGCGGCGGCCCTCGAGCA CGACAAGGCCTACGACCAGCAGCTCAAGGCCGGAGACAACCCGTACCTCAAGTACA ACCACGCCGACGCCGAGTTCCAGGAGCGGCTCAAAGAAGATACGTCTTTTGGGGGC AACCTCGGGCGAGCAGTCTTCCAGGCCAAAAAGAGGCTTCTTGAACCTCTTGGTCT GGTTGAGGAAGCGGCTAAGACGGCTCCTGGAAAGAAGAGGCCTGTAGAGCAGTCTC CTCAGGAACCGGACTCCTCCGCGGGTATTGGCAAATCGGGTGCACAGCCCGCTAAA AAGAGACTCAATTTCGGTCAGACTGGCGACACAGAGTCAGTCCCAGACCCTCAACC AATCGGAGAACCTCCCGCAGCCCCCTCAGGTGTGGGATCTCTTACAATGGCTTCAG GTGGTGGCGCACCAGTGGCAGACAATAACGAAGGTGCCGATGGAGTGGGTAGTTCC TCGGGAAATTGGCATTGCGATTCCCAATGGCTGGGGACAGAGTCATCACCACCAG CACCCGAACCTGGGCCCTGCCCACCTACAACAATCACCTCTACAAGCAAATCTCCA ACAGCACATCTGGAGGATCTTCAAATGACAACGCCTACTTCGGCTACAGCACCCCC TGGGGGTATTTTGACTTCAACAGATTCCACTGCCACTTCTCACCACGTGACTGGCA GCGACTCATCAACAACAACTGGGGATTCCGGCCTAAGCGACTCAACTTCAAGCTCT TCAACATTCAGGTCAAAGAGGTTACGGACAACAATGGAGTCAAGACCATCGCCAAT AACCTTACCAGCACGGTCCAGGTCTTCACGGACTCAGACTATCAGCTCCCGTACGT GCTCGGGTCGGCTCACGAGGGCTGCCTCCCGCCGTTCCCAGCGGACGTTTTCATGA TTCCTCAGTACGGGTATCTGACGCTTAATGATGGAAGCCAGGCCGTGGGTCGTTCG TCCTTTTACTGCCTGGAATATTTCCCGTCGCAAATGCTAAGAACGGGTAACAACTT CCAGTTCAGCTACGAGTTTGAGAACGTACCTTTCCATAGCAGCTACGCTCACAGCC AAAGCCTGGACCGACTAATGAATCCACTCATCGACCAATACTTGTAtTActTgagt AAaACaATTAACGGACACGACAGCCCACACAAAAGCGGACAAAACCAACAGACCtT gAAgTTttcgGTaGCtGGtCCtAGCAACATGGCTGTCCAGGGAAGAAACTACATAC CTGGACCCAGCTACCGACAACAACGTGTCTCAACCACTGTGACTCAAAACAACAAC AGCGAATTTGCTTGGCCTGGAGCTTCTTCTTGGGCTCTCAATGGACGTAATAGCTT GATGAATCCTGGACCTGCTATGGCCAGCCACAAAGAAGGAGAGGACCGTTTCTTTC CTTTGTCTGGATCTTTAATTTTTGGCAAACAAGGAACTGGAAGAGACAACGTGGAT GCGGACAAAGTCATGATAACCAACGAAGAAGAAATTAAAACTACTAACCCGGTAGC AACGGAGTCCTATGGACAAGtggccacaaaccaccagagtGCCCAAGCACAGGCGC AGaccggctgggttcaaaaccaAGGAATACTTCCGGGTATGGTTTGGCAGGACAGA |

TABLE 5-continued

Exemplary full length capsid nucleic acid sequences

| Name and Annotation | SEQ ID NO: | NT Sequence |
|---|---|---|
| | | GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTaTAA |
| TTM-023 | 12 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGGAGCGTGTGTCTGGTTCTCCGCATTCTAAGGCGCAGAATCAGCAGACGtT<br>gAAgTTttcgTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-004 | 13 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGGCGGAGATTGGTCATGATTCTCCGCATAAGTCTGGTCAGAATCAGCAGACGtT |

TABLE 5-continued

Exemplary full length capsid nucleic acid sequences

| Name and Annotation | SEQ ID NO: | NT Sequence |
|---|---|---|
| | | gAAgTTttcgGTaGCtGGtCCtAGCAAcATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTAATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-005 | 14 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGATTATTGGTTCTGGTTCTCCGCATTCTAAGGCGCAGAATCGTCATACGtT<br>gAAgTTttcgGTaGCtGGtCCtAGCAAcATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-006 | 15 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT |

TABLE 5-continued

Exemplary full length capsid nucleic acid sequences

| Name and Annotation | SEQ ID NO: | NT Sequence |
|---|---|---|
| | | TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGGAGAAGATGTCTGGTTCTCCGCATTCTAAGGCGCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-007 | 16 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGGAGATTAATGGTCGTGGTTCTCCGCATTCTAAGGCGCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-008 | 17 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA |

TABLE 5-continued

Exemplary full length capsid nucleic acid sequences

| Name and Annotation | SEQ ID NO: | NT Sequence |
|---|---|---|
| | | AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGTTTAATGGTTCTGGTTCTCCGCATTCTAAGGCGCCGAATCTGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-009 | 18 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGGAGAAGACGTCTGGTTCTCCGCATTCTAAGGCGCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |

TABLE 5-continued

Exemplary full length capsid nucleic acid sequences

| Name and Annotation | SEQ ID NO: | NT Sequence |
|---|---|---|
| TTM-010 | 19 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGATGAATGGTCATGATTCTCCGCATTCTAAGGCGCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-011 | 20 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGATTGATGGTCATGATTCTCCGCATTCTAAGGCGCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA |

TABLE 5-continued

Exemplary full length capsid nucleic acid sequences

| Name and Annotation | SEQ ID NO: | NT Sequence |
|---|---|---|
| | | GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-012 | 21 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGAATAATGGTCATGATTCTCCGCATTCTAAGGCGCAGAATCAGCAGACGtT<br>gAAgTTttcgTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-013 | 22 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGCAGCGTAAGTCTGGTTCTCCGCATTCTAAGGCGCAGAATCAGCAGACGtT |

TABLE 5-continued

Exemplary full length capsid nucleic acid sequences

| Name and Annotation | SEQ ID NO: | NT Sequence |
|---|---|---|
| | | gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-014 | 23 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGCTAATGAATCCACTCATCGAtCAgTAtcTGTAtTActTgagt<br>AAGACGATTAATGGTTCTGGTTCTCCGCATTCTAAGGCGCAGGCGCGTAAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-015 | 24 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT |

TABLE 5-continued

Exemplary full length capsid nucleic acid sequences

| Name and Annotation | SEQ ID NO: | NT Sequence |
|---|---|---|
| | | TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGTATATTGTGGGTTCTGGTTCTCCGCATTCTAAGGCGCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACGcGgTAttTAACgaGgAActTa |
| TTM-016 | 25 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGATTTCTAAGCGTGGTTCTCCGCATTCTAAGGCGCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACGcGgTAttTAACgaGgAActTa |
| TTM-017 | 26 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA |

TABLE 5-continued

Exemplary full length capsid nucleic acid sequences

| Name and Annotation | SEQ ID NO: | NT Sequence |
|---|---|---|
| | | AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCCTTTCCATAGCAGCTACGCTCACAGCC<br>AAAGCCTGGACCGACTAATGAATCCACTCATCGAtCAgTAtcTGTAtTActTgagt<br>AAGGGTCTGGGTGGTTCTGGTTCTCCGCATTCTAAGGCGCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-018 | 27 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCCTTTCCATAGCAGCTACGCTCACAGCC<br>AAAGCCTGGACCGACTAATGAATCCACTCATCGAtCAgTAtcTGTAtTActTgagt<br>AAGACGATTAATGGTCATGATTCTCCGCATTCTAAGGCGCAGAATCTGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |

TABLE 5-continued

Exemplary full length capsid nucleic acid sequences

| Name and Annotation | SEQ ID NO: | NT Sequence |
|---|---|---|
| TTM-019 | 28 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGGTGAATGGTCATGATTCTCCGCATTCTAAGGCGCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-020 | 29 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGGATTAATGGTCATGATTCTCCGCATTCTAAGGCGCTGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA |

TABLE 5-continued

Exemplary full length capsid nucleic acid sequences

| Name and Annotation | SEQ ID NO: | NT Sequence |
|---|---|---|
| | | GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-021 | 30 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGATTAATGGTCATGATTCTCCGCATTCTAAGGCGCAGAATCAGCAGTCTtT<br>gAAgTTttcgTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-022 | 31 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGATTAATGGTCATGATTCTCCGCATTCTAAGGCGCAGAATCAGCAGATTtT |

TABLE 5-continued

Exemplary full length capsid nucleic acid sequences

| Name and Annotation | SEQ ID NO: | NT Sequence |
|---|---|---|
| | | gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-023 | 32 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGCTAATGAATCCACTCATCGAtCAgTAtcTGTAtTActTgagt<br>AAGACGATTAATGGTTCTGGTTCTCCGCATTTTACGCGTCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-024 | 33 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATACGTCTTTTGGGGGC<br>AACCTCGGGCGAGCAGTCTTCCAGGCCAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT |

TABLE 5-continued

Exemplary full length capsid nucleic acid sequences

| Name and Annotation | SEQ ID NO: | NT Sequence |
|---|---|---|
| | | TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGTCTAATGGTCATGATTCTCCGCATTCTAAGGCGCAGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-025 | 34 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATCGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA<br>AAGAGACTCAATTTCGGTCAGACTGGCGACACAGAGTCAGTCCCAGACCCTCAACC<br>AATCGGAGAACCTCCCGCAGCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGATTAATGGTTCTGGTTCTCCGCATTCTCTGCCGTGGAATCAGCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |
| TTM-026 | 35 | ATGGCTGCCGATGGTTATCTTCCAGattggcTCGAGGACAACCTTAGTGAAGGAAT<br>TCGCGAGTGGTGGGCTTTGAAACCTGGAGCCCCTCAACCCAAGGCAAATCAACAAC<br>ATCAAGACAACGCTCGAGGTCTTGTGCTTCCGGGTTACAAATACCTTGGACCCGGC<br>AACGGACTCGACAAGGGGGAGCCGGTCAACGCAGCAGACGCGGCGGCCCTCGAGCA<br>CGACAAGGCCTACGACCAGCAGCTCAAGGCCGGAGACAACCCGTACCTCAAGTACA<br>ACCACGCCGACGCCGAGTTCCAGGAGCGGCTCAAAGAAGATCGTCTTTTGGGGGC<br>AACCTCGGGCGAGCAGTCTTCCAGGCCAAAAAGAGGCTTCTTGAACCTCTTGGTCT<br>GGTTGAGGAAGCGGCTAAGACGGCTCCTGGAAAGAAGAGGCCTGTAGAGCAGTCTC<br>CTCAGGAACCGGACTCCTCCGCGGGTATTGGCAAATCGGGTGCACAGCCCGCTAAA |

TABLE 5-continued

Exemplary full length capsid nucleic acid sequences

| Name and Annotation | SEQ ID NO: | NT Sequence |
|---|---|---|
| | | AAGAGACTCAATTTCGGTCAGACTGGCGACACAGAGTCAGTCCCAGACCCTCAACC<br>AATCGGAGAACCTCCCGCAGCCCCCTCAGGTGTGGGATCTCTTACAATGGCTTCAG<br>GTGGTGGCGCACCAGTGGCAGACAATAACGAAGGTGCCGATGGAGTGGGTAGTTCC<br>TCGGGAAATTGGCATTGCGATTCCCAATGGCTGGGGGACAGAGTCATCACCACCAG<br>CACCCGAACCTGGGCCCTGCCCACCTACAACAATCACCTCTACAAGCAAATCTCCA<br>ACAGCACATCTGGAGGATCTTCAAATGACAACGCCTACTTCGGCTACAGCACCCCC<br>TGGGGGTATTTTGACTTCAACAGATTCCACTGCCACTTCTCACCACGTGACTGGCA<br>GCGACTCATCAACAACAACTGGGGATTCCGGCCTAAGCGACTCAACTTCAAGCTCT<br>TCAACATTCAGGTCAAAGAGGTTACGGACAACAATGGAGTCAAGACCATCGCCAAT<br>AACCTTACCAGCACGGTCCAGGTCTTCACGGACTCAGACTATCAGCTCCCGTACGT<br>GCTCGGGTCGGCTCACGAGGGCTGCCTCCCGCCGTTCCCAGCGGACGTTTTCATGA<br>TTCCTCAGTACGGGTATCTGACGCTTAATGATGGAAGCCAGGCCGTGGGTCGTTCG<br>TCCTTTTACTGCCTGGAATATTTCCCGTCGCAAATGCTAAGAACGGGTAACAACTT<br>CCAGTTCAGCTACGAGTTTGAGAACGTACCTTTCCATAGCAGCTACGCTCACAGCC<br>AAAGCCTGGACCGACTAATGAATCCACTCATCGAtCAgTAtcTGTAtTActTgagt<br>AAGACGATTAATGGTCATGATTCTCCGCATTCTAAGGCGCAGAATCATCAGACGtT<br>gAAgTTttcgGTaGCtGGtCCtAGCAACATGGCTGTCCAGGGAAGAAACTACATAC<br>CTGGACCCAGCTACCGACAACAACGTGTCTCAACCACTGTGACTCAAAACAACAAC<br>AGCGAATTTGCTTGGCCTGGAGCTTCTTCTTGGGCTCTCAATGGACGTAATAGCTT<br>GATGAATCCTGGACCTGCTATGGCCAGCCACAAAGAAGGAGAGGACCGTTTCTTTC<br>CTTTGTCTGGATCTTTAATTTTTGGCAAACAAGGAACTGGAAGAGACAACGTGGAT<br>GCGGACAAAGTCATGATAACCAACGAAGAAGAAATTAAAACTACTAACCCGGTAGC<br>AACGGAGTCCTATGGACAAGtggccacaaaccaccagagtGCCCAAGCACAGGCGC<br>AGaccggctgggttcaaaaccaAGGAATACTTCCGGGTATGGTTTGGCAGGACAGA<br>GATGTGTACCTGCAAGGACCCATTTGGGCCAAAATTCCTCACACGGACGGCAACTT<br>TCACCCTTCTCCGCTGATGGGAGGGTTTGGAATGAAGCACCCGCCTCCTCAGATCC<br>TCATCAAAAACACACCTGTACCTGCGGATCCTCCAACGGCCTTCAACAAGGACAAG<br>CTGAACTCTTTCATCACCCAGTATTCTACTGGCCAAGTCAGCGTGGAGATCGAGTG<br>GGAGCTGCAGAAGGAAAACAGCAAGCGCTGGAACCCGGAGATCCAGTACACTTCCA<br>ACTATTACAAGTCTAATAATGTTGAATTTGCTGTTAATACTGAAGGTGTATATAGT<br>GAACCCCGCCCCATTGGCACgcGgTAttTAACgaGgAActTa |

In some embodiments, the polynucleotide encoding an AAV capsid variant, described herein comprises the nucleotide sequence of SEQ ID NO: 983 or 984, or a nucleotide sequence with at least 70% (e.g., at least about 80, 85, 90, 95, 96, 97, 98, or 99%) sequence identity thereto.

In some embodiments, the polynucleotide encoding an AAV capsid variant, described herein comprises the nucleotide sequence of any one of SEQ ID NOs: 12-35, or a nucleotide sequence with at least 70% (e.g., at least about 80, 85, 90, 95, 96, 97, 98, or 99%) sequence identity thereto.

In some embodiments, the polynucleotide encoding an AAV capsid variant described herein comprises the nucleotide sequence of SEQ ID NO: 983, or a nucleotide sequence with at least 70% (e.g., at least about 80, 85, 90, 95, 96, 97, 98, or 99%) sequence identity thereto. In some embodiments, the nucleotide sequence encoding an AAV capsid variant described herein, comprises a nucleotide sequence comprising at least one, two or three modifications, e.g., substitutions (e.g., conservative substitutions), insertions, or deletions, but not more than 30, 20 or 10 modifications, e.g., substitutions (e.g., conservative substitutions), insertions, or deletions, relative to the nucleotide sequence of SEQ ID NO: 983. In some embodiments, the nucleotide sequence encoding an AAV capsid variant described herein, comprises a nucleotide sequence comprising at least one, two or three, but not more than 30, 20 or 10 different nucleotides relative to the amino acid sequence of SEQ ID NO: 983. In some embodiments, the nucleic acid sequence encoding an AAV capsid variant described herein is codon optimized.

In some embodiments, the polynucleotide encoding an AAV capsid variant described herein comprises the nucleotide sequence of SEQ ID NO: 984, or a nucleotide sequence with at least 70% (e.g., at least about 80, 85, 90, 95, 96, 97, 98, or 99%) sequence identity thereto. In some embodiments, the nucleotide sequence encoding an AAV capsid variant described herein, comprises a nucleotide sequence comprising at least one, two or three modifications, e.g., substitutions (e.g., conservative substitutions), insertions, or deletions, but not more than 30, 20 or 10 modifications, e.g., substitutions (e.g., conservative substitutions), insertions, or deletions, relative to the nucleotide sequence of SEQ ID NO: 984. In some embodiments, the nucleotide sequence encoding an AAV capsid variant described herein, comprises a nucleotide sequence comprising at least one, two or three, but not more than 30, 20 or 10 different nucleotides, relative to the amino acid sequence of SEQ ID NO: 984. In some embodiments, the nucleic acid sequence encoding an AAV capsid variant described herein is codon optimized.

In some embodiments, an AAV capsid variant described herein comprises the amino acid sequence of any one of SEQ ID NOs: 36-59, 981, or 982, or an amino acid sequence with at least 70% (e.g., at least about 80, 85, 90, 95, 96, 97, 98, or 99%) sequence identity thereto. In some embodiments, an AAV capsid variant described herein comprises an amino acid sequence comprising at least one, two, or three modifications, e.g., substitutions (e.g., conservative substitutions), insertions, or deletions, but not more than 30, 20 or 10 modifications, e.g., substitutions (e.g., conservative substitutions), insertions, or deletions, relative to the amino acid sequence of SEQ ID NO: 36-59, 981, or 982. In some embodiments, the AAV capsid variant, comprises an amino acid sequence comprising at least one, two or three, but not more than 30, 20 or 10 different amino acids, relative to the amino acid sequence of SEQ ID NO: 36-59, 981, or 982.

In some embodiments, an AAV capsid variant described herein, comprises the amino acid sequence of SEQ ID NO:

981, or an amino acid sequence with at least 70% (e.g., at least about 80, 85, 90, 95, 96, 97, 98, or 99%) sequence identity thereto. In some embodiments, an AAV capsid variant described herein comprises an amino acid sequence comprising at least one, two, or three modifications, e.g., substitutions (e.g., conservative substitutions), insertions, or deletions, but not more than 30, 20 or 10 modifications, e.g., substitutions (e.g., conservative substitutions), insertions, or deletions, relative to the amino acid sequence of SEQ ID NO: 981. In some embodiments, an AAV capsid variant described herein comprises an amino acid sequence comprising at least one, two or three, but not more than 30, 20 or 10 different amino acids, relative to the amino acid sequence of SEQ ID NO: 981.

In some embodiments, an AAV capsid variant described herein comprises the amino acid sequence of SEQ ID NO: 982, or an amino acid sequence with at least 70% (e.g., at least about 80, 85, 90, 95, 96, 97, 98, or 99%) sequence identity thereto. In some embodiments, an AAV capsid variant described herein comprises an amino acid sequence comprising at least one, two, or three modifications, e.g., substitutions (e.g., conservative substitutions), insertions, or deletions, but not more than 30, 20 or 10 modifications, e.g., substitutions (e.g., conservative substitutions), insertions, or deletions, relative to the amino acid sequence of SEQ ID NO: 982. In some embodiments, the AAV capsid variant, comprises an amino acid sequence comprising at least one, two or three, but not more than 30, 20 or 10 different amino acids, relative to the amino acid sequence of SEQ ID NO: 982.

In some embodiments, an AAV capsid variant described herein comprises the amino acid sequence of SEQ ID NO: 36, or an amino acid sequence with at least 70% (e.g., at least about 80, 85, 90, 95, 96, 97, 98, or 99%) sequence identity thereto. In some embodiments, an AAV capsid variant described herein comprises an amino acid sequence comprising at least one, two, or three modifications, e.g., substitutions (e.g., conservative substitutions), insertions, or deletions, but not more than 30, 20 or 10 modifications, e.g., substitutions (e.g., conservative substitutions), insertions, or deletions, relative to the amino acid sequence of SEQ ID NO: 36. In some embodiments, the AAV capsid variant, comprises an amino acid sequence comprising at least one, two or three, but not more than 30, 20 or 10 different amino acids, relative to the amino acid sequence of SEQ ID NO: 36.

In some embodiments, an AAV capsid variant described herein comprises the amino acid sequence of SEQ ID NO: 39, or an amino acid sequence with at least 70% (e.g., at least about 80, 85, 90, 95, 96, 97, 98, or 99%) sequence identity thereto. In some embodiments, an AAV capsid variant described herein comprises an amino acid sequence comprising at least one, two, or three modifications, e.g., substitutions (e.g., conservative substitutions), insertions, or deletions, but not more than 30, 20 or 10 modifications, e.g., substitutions (e.g., conservative substitutions), insertions, or deletions, relative to the amino acid sequence of SEQ ID NO: 39. In some embodiments, the AAV capsid variant, comprises an amino acid sequence comprising at least one, two or three, but not more than 30, 20 or 10 different amino acids, relative to the amino acid sequence of SEQ ID NO: 39.

In some embodiments, an AAV capsid variant described herein comprises the amino acid sequence of SEQ ID NO: 51, or an amino acid sequence with at least 70% (e.g., at least about 80, 85, 90, 95, 96, 97, 98, or 99%) sequence identity thereto. In some embodiments, an AAV capsid variant described herein comprises an amino acid sequence comprising at least one, two, or three modifications, e.g., substitutions (e.g., conservative substitutions), insertions, or deletions, but not more than 30, 20 or 10 modifications, e.g., substitutions (e.g., conservative substitutions), insertions, or deletions, relative to the amino acid sequence of SEQ ID NO: 51. In some embodiments, the AAV capsid variant, comprises an amino acid sequence comprising at least one, two or three, but not more than 30, 20 or 10 different amino acids, relative to the amino acid sequence of SEQ ID NO: 51.

In some embodiments, an AAV capsid variant described herein comprises the amino acid sequence of SEQ ID NO: 52, or an amino acid sequence with at least 70% (e.g., at least about 80, 85, 90, 95, 96, 97, 98, or 99%) sequence identity thereto. In some embodiments, an AAV capsid variant described herein comprises an amino acid sequence comprising at least one, two, or three modifications, e.g., substitutions (e.g., conservative substitutions), insertions, or deletions, but not more than 30, 20 or 10 modifications, e.g., substitutions (e.g., conservative substitutions), insertions, or deletions, relative to the amino acid sequence of SEQ ID NO: 52. In some embodiments, the AAV capsid variant, comprises an amino acid sequence comprising at least one, two or three, but not more than 30, 20 or 10 different amino acids, relative to the amino acid sequence of SEQ ID NO: 52.

In some embodiments, an AAV capsid variant described herein comprises an amino acid sequence encoded by the nucleotide sequence of SEQ ID NO: 983 or 984, or a nucleotide sequence with at least 70% (e.g., at least about 80, 85, 90, 95, 96, 97, 98, or 99%) sequence identity thereto. In some embodiments, an AAV capsid variant described herein comprises an amino acid sequence encoded by a nucleotide sequence comprising at least one, two or three, but not more than 30, 20 or 10 different nucleotides, relative to the amino acid sequence of SEQ ID NO: 983 or 984. In some embodiments, an AAV capsid variant described herein comprises an amino acid sequence encoded by a nucleotide sequence comprising at least one, two or three modifications, e.g., substitutions, insertions, or deletions, but not more than 30, 20 or 10 modifications, e.g., substitutions, insertions, or deletions, relative to the nucleotide sequence of SEQ ID NO: 983 or 984.

In some embodiments, an AAV capsid variant described herein comprises an amino acid sequence encoded by the nucleotide sequence of any one of SEQ ID NOs: 12-35, or a nucleotide sequence with at least 70% (e.g., at least about 80, 85, 90, 95, 96, 97, 98, or 99%) sequence identity thereto. In some embodiments, an AAV capsid variant described herein comprises an amino acid sequence encoded by a nucleotide sequence comprising at least one, two or three, but not more than 30, 20 or 10 different nucleotides, relative to the amino acid sequence of any one of SEQ ID NOs: 12-35. In some embodiments, an AAV capsid variant described herein comprises an amino acid sequence encoded by a nucleotide sequence comprising at least one, two or three modifications, e.g., substitutions, insertions, or deletions, but not more than 30, 20 or 10 modifications, e.g., substitutions, insertions, or deletions, relative to the nucleotide sequence of any one of SEQ ID NOs: 12-35.

In some embodiments, an AAV capsid variant described herein comprises a VP1, VP2, VP3 protein, or a combination thereof. In some embodiments, an AAV capsid variant comprises the amino acid sequence corresponding to positions 138-742, e.g., a VP2, of SEQ ID NO: 981 or 982, or a sequence with at least 70% (e.g., at least about 80, 85, 90, 95, 96, 97, 98, or 99%) sequence identity thereto. In some embodiments, the AAV capsid protein comprises the amino acid sequence corresponding to positions 203-742, e.g., a VP3, of SEQ ID NO: 981 or 982, or a sequence with at least 70% (e.g., at least about 80, 85, 90, 95, 96, 97, 98, or 99%) sequence identity thereto. In some embodiments, the AAV capsid variant comprises the amino acid sequence corresponding to positions 1-742, e.g., a VP1, of SEQ ID NO: 981 or 982, or an amino acid sequence with at least 70% (e.g., at least about 80, 85, 90, 95, 96, 97, 98, or 99%) sequence identity thereto.

In some embodiments, an AAV capsid variant described herein comprises a VP1, VP2, VP3 protein, or a combination thereof. In some embodiments, an AAV capsid variant comprises the amino acid sequence corresponding to positions 138-742, e.g., a VP2, of any one of SEQ ID NOs: 36-59, or a sequence with at least 70% (e.g., at least about 80, 85, 90, 95, 96, 97, 98, or 99%) sequence identity thereto. In some embodiments, the AAV capsid protein comprises the amino acid sequence corresponding to positions 203-742, e.g., a VP3, of any one of SEQ ID NOs: 36-59, or a sequence with at least 70% (e.g., at least about 80, 85, 90, 95, 96, 97, 98, or 99%) sequence identity thereto. In some embodiments, the AAV capsid variant comprises the amino acid sequence corresponding to positions 1-742, e.g., a VP1, of any one of SEQ ID NOs: 36-59, or an amino acid sequence with at least 70% (e.g., at least about 80, 85, 90, 95, 96, 97, 98, or 99%) sequence identity thereto.

In some embodiments, an AAV capsid variant, described herein has an increased tropism for a CNS cell or tissue, e.g., a brain cell, brain tissue, spinal cord cell, or spinal cord tissue, relative to the tropism of a reference sequence comprising the amino acid sequence of SEQ ID NO: 138.

In some embodiments, an AAV capsid variant described herein transduces a brain region, e.g., a midbrain region (e.g., the hippocampus, or thalamus) or the brain stem. In some embodiments, the level of transduction is at least 5, 10, 15, 20, 25, 30, 35, 40, 45, 50, 55, 60, or 65-fold greater as compared to a reference sequence of SEQ ID NO: 138. In some embodiments, the level of transduction is at least 30, 35, 40, 45, 50, 55, 60, or 65-fold greater as compared to a reference sequence of SEQ ID NO: 138.

In some embodiments, an AAV capsid variant described herein is enriched at least about 3, 4, 5, 6, 7, 8, 9, or 10-fold in the brain compared to a reference sequence of SEQ ID NO: 138. In some embodiments, an AAV capsid variant described herein is enriched at least about 20, 25, 30, 35, 40, 45, 50, 55, 60, 65, 70, 75, 80 or 85-fold in the brain compared to a reference sequence of SEQ ID NO: 138.

In some embodiments, an AAV capsid variant described herein is enriched in the brain of at least two to three species, e.g., a non-human primate and rodent (e.g., mouse) species, compared to a reference sequence of SEQ ID NO: 138. In some embodiments, an AAV capsid variant described herein is enriched at least about 10, 15, 20, 25, 30, 35, 40, 45, 50, 55, 60, 65, 70, 75, 80, 85, 90, 95, or 100-fold in the brain of at least two to three species, e.g., a non-human primate and rodent (e.g., mouse) species, compared to a reference sequence of SEQ ID NO: 138. In some embodiments, the at least two to three species are *Macaca fascicularis, Chlorocebus sabaeus, Callithrix jacchus*, and/or mouse (e.g., BALB/c mice, C57Bl/6 mice, and/or CD-1 outbred mice).

In some embodiments, an AAV capsid variant described herein is enriched at least about 2, 2.5, 3, 3.5, 4, 4.5, 5, 5.5, 6, 6.5, 7, 7.5, or 8-fold, in the brain compared to a reference sequence of SEQ ID NO: 981. In some embodiments, an AAV capsid variant described herein is enriched about 2, 2.5, 3, 3.5, 4, 4.5, 5, or 5.5-fold, in the brain compared to a reference sequence of SEQ ID NO: 982.

In some embodiments, an AAV capsid variant described herein delivers an increased level of viral genomes to a brain region. In some embodiments, the level of viral genomes is increased by at least 20, 25, 30, 35, 40, 45, or 50-fold, as compared to a reference sequence of SEQ ID NO: 138. In some embodiments, the brain region comprises a midbrain region (e.g., the hippocampus or thalamus) and/or the brainstem.

In some embodiments, an AAV capsid variant described herein delivers an increased level of a payload to a brain region. In some embodiments, the level of the payload is increased by at least 20, 25, 30, 35, 40, 45, 50, 55, 60, 65, or 70-fold, as compared to a reference sequence of SEQ ID NO: 138. In some embodiments, the brain region comprises a midbrain region (e.g., the hippocampus or thalamus) and/or the brainstem.

In some embodiments, an AAV capsid variant described herein is enriched at least about 5, 10, 15, 20, 25, 30, or 35-fold, in the spinal cord compared to a reference sequence of SEQ ID NO: 138.

In some embodiments, an AAV capsid variant described herein shows preferential transduction in a brain region relative to the transduction in the dorsal root ganglia (DRG). In some embodiments, the AAV capsid variant shows preferential transduction in a brain region relative to the transduction in the liver. In some embodiments, the AAV capsid variant shows preferential transduction in a brain region relative to the transduction in the liver and the DRG. In some embodiments, the AAV capsid variant shows preferential transduction in a brain region relative to the transduction in the heart. In some embodiments, the AAV capsid variant shows preferential transduction in a brain region relative to the transduction in the heart and DRG. In some embodiments, the AAV capsid variant shows preferential transduction in a brain region relative to the transduction in the heart, DRG, and liver. In some embodiments, the AAV capsid variant shows preferential transduction in a brain region and/or a heart region relative to the transduction in the liver and DRG.

In some embodiments, an AAV capsid variant described herein is capable of transducing non-neuronal cells, e.g., glial cells (e.g., oligodendrocytes or astrocytes). In some embodiments, the AAV capsid variant described herein is capable of transducing neuronal cells and non-neuronal cells, e.g., glial cells (e.g., oligodendrocytes or astrocytes). In some embodiments, the non-neuronal cells are glial cells, oligodendrocytes (e.g., Olig2 positive oligodendrocytes), or astrocytes (e.g., Olig2 positive astrocytes). In some embodiments, the AAV capsid variant is capable of transducing Olig2 positive cells, e.g., Olig2 positive astrocytes or Olig2 positive oligodendrocytes.

In some embodiments, an AAV capsid polypeptide, e.g., an AAV capsid variant, described herein has an increased tropism for a muscle cell or tissue, e.g., a heart or quadriceps cell or tissue, relative to the tropism of a reference sequence comprising the amino acid sequence of SEQ ID NO: 138. In some embodiments, the AAV capsid variant is enriched at least about 4, 5, 8, 12, 17, 18, 20, 26, 27, 28, 30, or 36-fold, in the muscle compared to a reference sequence of SEQ ID NO: 138. In some embodiments, the muscle region comprises a quadriceps muscle, heart muscle, and/or a diaphragm muscle region. In some embodiments, the muscle region comprises a heart muscle region, e.g., a heart atrium muscle region or a heart ventricle muscle region.

In some embodiments, an AAV capsid polypeptide, e.g., an AAV capsid variant, described herein has an increased tropism for a heart cell or heart tissue. In some embodiments, the AAV capsid variant is enriched at least about 4, 5, 8, 10, 11, 12, 13, 14, 18, 19, 20, 21, 22, 24, 25, 27, 31, 33, or 34-fold, in the heart compared to a reference sequence of SEQ ID NO: 138.

In some embodiments, an AAV capsid variant described herein has increased tropism for a liver cell or tissue, relative to the tropism of a reference sequence comprising the amino acid sequence of SEQ ID NO: 138. In some embodiments, the AAV capsid variant is enriched at least about 10, 15, 20, 25, 30, 35, 40, 45, 50, 55, 60, 65, 70, 75, 80, 85, 90, 95, 100, 105, 110, 115, 120, 125, 130, 135, 140, 150, 160, 170, 180, 190, or 200-fold, in the liver compared to a reference sequence of SEQ ID NO: 138. In some embodiments, the AAV capsid variant has reduced tropism for a CNS cell or tissue, e.g., a brain cell, brain tissue, spinal cord cell, or spinal cord tissue, relative to the tropism of a reference sequence comprising the amino acid sequence of SEQ ID NO: 138. In some embodiments, the AAV capsid variant shows preferential transduction in a liver region relative to the transduction in the brain and/or dorsal root ganglia (DRG). In some embodiments, the AAV capsid variant shows preferential transduction in a liver region relative to the transduction in the heart and/or muscle (e.g., quadriceps).

In some embodiments, an AAV capsid variant of the present disclosure has decreased tropism for the liver. In some embodiments, an AAV capsid variant comprises a modification, e.g., substitution (e.g., conservative substitution), insertion, or deletion, that results in reduced tropism (e.g., de-targeting) and/or activity in the liver. In some embodiments, the reduced tropism in the liver is compared to an otherwise similar capsid that does not comprise the modification, e.g., a wild-type capsid. In some embodiments, an AAV capsid variant described herein comprises a modification, e.g., substitution (e.g., conservative substitution), insertion, or deletion that results in one or more of the following properties: (1) reduced tropism in the liver; (2) reduced, e.g., de-targeted, expression in the liver; (3) reduced activity in the liver; and/or (4) reduced binding to galactose. In some embodiments, the reduction in any one, or all of properties (1)-(3) is compared to an otherwise similar AAV capsid variant that does not comprise the modification. Exemplary modifications are provided in WO 2018/119330; Pulicherla et al. (2011) *Mol. Ther.* 19(6): 1070-1078; Adachi et al. (2014) *Nature Communications* 5(3075), DOI: 10.1038/ncomms4075; and Bell et al. (2012) *J. Virol.* 86(13): 7326-33; the contents of which are hereby incorporated by reference in their entirety. In some embodiments, the AAV capsid variant comprises a modification e.g., substitution (e.g., conservative substitution), insertion, or deletion, at position N470 (e.g., N470A), D271 (e.g., D271A), N272 (e.g., N297A), Y446 (e.g., Y446A), N498 (e.g., N498Y or N498I), W503 (e.g., W530R or W530A), L620 (e.g., L620F), or a combination thereof, relative to a reference sequence numbered according to SEQ ID NO: 138. In some embodiments, the AAV capsid variant comprises one, two, three, four, five or all of an amino acid other than N at position 470 (e.g., A), an amino acid other than D at position 271 (e.g., A), an amino acid other than N at position 272 (e.g., A), an amino acid other than Y at position 446 (e.g., A), and amino acid other than N at position 498/(e.g., Y or I), and amino acid other than W at position 503 (e.g., R or A), and amino acid other than L at position 620 (e.g., F), relative to a reference sequence numbered according to SEQ ID NO: 138. In some embodiments, the AAV capsid variant comprises a modification e.g., substitution (e.g., conservative substitution), insertion, or deletion, at position N470 (e.g., N470A), D271 (e.g., D271A), N272 (e.g., N297A), Y446 (e.g., Y446A), and W503 (e.g., W530R or W530A), relative to a reference sequence numbered according to SEQ ID NO: 138. In some embodiments, the AAV capsid variant comprises a modification e.g., substitution (e.g., conservative substitution), insertion, or deletion, at N498 (e.g., N498Y) and L620 (e.g., L620F).

In some embodiments, an AAV capsid variant comprised herein comprises a modification as described in Adachi et al. (2014) *Nature Communications* 5(3075), DOI: 10.1038/ncomms4075, the contents of which are hereby incorporated by reference in its entirety. Exemplary modifications that alter or do not alter tissue transduction in at least the brain, liver, heart, lung, and/or kidney can be found in Supplementary Data 2 showing the AAV Barcode-Seq data obtained with AAV9-AA-VBCLib of Adachi et al. (supra), the contents of which are hereby incorporated by reference in its entirety.

In some embodiments, an AAV capsid variant of the present disclosure is isolated, e.g., recombinant. In some embodiments, a polynucleotide encoding an AAV capsid polypeptide, e.g., an AAV capsid variant, of the present disclosure is isolated, e.g., recombinant.

Also provided herein are polynucleotide sequences encoding any of the AAV capsid variants described above and AAV particles, vectors, and cells comprising the same.

AAV Serotypes and Capsids

In some embodiments, an AAV particle of the present disclosure may comprise a capsid protein or variant thereof any natural or recombinant AAV serotype. AAV serotypes may differ in characteristics such as, but not limited to, packaging, tropism, transduction and immunogenic profiles. While not wishing to be bound by theory, it is believed in some embodiments, that the AAV capsid protein, e.g., an AAV capsid variant, can modulate, e.g., direct, AAV particle tropism to a particular tissue.

In some embodiments, an AAV capsid variant described herein allows for blood brain barrier penetration following intravenous administration. In some embodiments, the AAV capsid variant allows for blood brain barrier penetration following intravenous administration, focused ultrasound (FUS), e.g., coupled with the intravenous administration of microbubbles (FUS-MB), or MRI-guided FUS coupled with intravenous administration. In some embodiments the AAV capsid variant allows for increased distribution to a brain region. In some embodiments, the brain region comprises a frontal cortex, sensory cortex, motor cortex, caudate, dentate nucleus, cerebellar cortex, cerebral cortex, brain stem, hippocampus, thalamus, putamen, or a combination thereof. In some embodiments, the AAV capsid variant allows for preferential transduction in a brain region relative to the transduction in the dorsal root ganglia (DRG). In some embodiments, the AAV capsid variant allows for transduction in a non-neuronal cell, e.g., a glial cell (e.g., an astrocyte, an oligodendrocyte, or a combination thereof).

In some embodiments, an AAV capsid variant allows for increased distribution to a spinal cord region. In some embodiments, the spinal region comprises a cervical spinal cord region, thoracic spinal cord region, and/or lumbar spinal cord region.

In some embodiments, the AAV capsid variant, is suitable for intramuscular administration and/or transduction of muscle fibers. In some embodiments the AAV capsid variant, allows for increased distribution to a muscle region. In some embodiments, the muscle region comprises a heart muscle, quadriceps muscle, a diaphragm muscle region, or a combination thereof. In some embodiments, the muscle region comprises a heart muscle region, e.g., a heart atrium muscle region or a heart ventricle muscle region.

In some embodiments, the initiation codon for translation of the AAV VP1 capsid protein, e.g., a capsid variant, described herein may be CTG, TTG, or GTG as described in U.S. Pat. No. 8,163,543, the contents of which are herein incorporated by reference in its entirety.

The present disclosure refers to structural capsid proteins (including VP1, VP2 and VP3) which are encoded by capsid (Cap) genes. These capsid proteins form an outer protein structural shell (e.g., capsid) of a viral vector such as AAV. VP capsid proteins synthesized from Cap polynucleotides generally include a methionine as the first amino acid in the peptide sequence (Met1), which is associated with the start codon (AUG or ATG) in the corresponding Cap nucleotide sequence. However, it is common for a first-methionine (Met1) residue or generally any first amino acid (AA1) to be cleaved off after or during polypeptide synthesis by protein processing enzymes such as Met-aminopeptidases. This "Met/AA-clipping" process often correlates with a corresponding acetylation of the second amino acid in the polypeptide sequence (e.g., alanine, valine, serine, threonine, etc.). Met-clipping commonly occurs with VP1 and VP3 capsid proteins but can also occur with VP2 capsid proteins.

Where the Met/AA-clipping is incomplete, a mixture of one or more (one, two or three) VP capsid proteins comprising the viral capsid may be produced, some of which may include a Met1/AA1 amino acid (Met+/AA+) and some of which may lack a Met1/AA1 amino acid as a result of Met/AA-clipping (Met-/AA-). For further discussion regarding Met/AA-clipping in capsid proteins, see Jin, et al. Direct Liquid Chromatography/Mass Spectrometry Analysis for Complete Characterization of Recombinant Adeno-Associated Virus Capsid Proteins. *Hum Gene Ther Methods.* 2017 Oct. 28(5):255-267; Hwang, et al. N-Terminal Acetylation of Cellular Proteins Creates Specific Degradation Signals. *Science.* 2010 Feb. 19. 327(5968): 973-977; the contents of which are each incorporated herein by reference in its entirety.

According to the present disclosure, references to capsid proteins, e.g., AAV capsid variants, is not limited to either clipped (Met-/AA-) or unclipped (Met+/AA+) and may, in context, refer to independent capsid proteins, viral capsids comprised of a mixture of capsid proteins, and/or polynucleotide sequences (or fragments thereof) which encode, describe, produce or result in capsid proteins of the present disclosure. A direct reference to a capsid protein or capsid polypeptide (such as VP1, VP2 or VP2) may also comprise VP capsid proteins which include a Met1/AA1 amino acid (Met+/AA+) as well as corresponding VP capsid proteins which lack the Met1/AA1 amino acid as a result of Met/AA-clipping (Met-/AA-).

Further according to the present disclosure, a reference to a specific SEQ ID NO: (whether a protein or nucleic acid) which comprises or encodes, respectively, one or more capsid proteins which include a Met1/AA1 amino acid (Met+/AA+) should be understood to teach the VP capsid proteins which lack the Met1/AA1 amino acid as upon review of the sequence, it is readily apparent any sequence which merely lacks the first listed amino acid (whether or not Met1/AA1).

As a non-limiting example, reference to a VP1 polypeptide sequence which is 736 amino acids in length, and which includes a "Met1" amino acid (Met+) encoded by the AUG/ATG start codon may also be understood to teach a VP1 polypeptide sequence which is 735 amino acids in length, and which does not include the "Met1" amino acid (Met-) of the 736 amino acid Met+ sequence. As a second non-limiting example, reference to a VP1 polypeptide sequence which is 736 amino acids in length, and which includes an "AA1" amino acid (AA1+) encoded by any NNN initiator codon may also be understood to teach a VP1 polypeptide sequence which is 735 amino acids in length, and which does not include the "AA1" amino acid (AA1-) of the 736 amino acid AA1+ sequence.

References to viral capsids formed from VP capsid proteins (such as reference to specific AAV capsid serotypes), can incorporate VP capsid proteins which include a Met1/AA1 amino acid (Met+/AA1+), corresponding VP capsid proteins which lack the Met1/AA1 amino acid as a result of Met/AA1-clipping (Met-/AA1-), and combinations thereof (Met+/AA1+ and Met-/AA1-).

As a non-limiting example, an AAV capsid serotype can include VP1 (Met+/AA1+), VP1 (Met-/AA1-), or a combination of VP1 (Met+/AA1+) and VP1 (Met-/AA1-). An AAV capsid serotype can also include VP3 (Met+/AA1+), VP3 (Met-/AA1-), or a combination of VP3 (Met+/AA1+) and VP3 (Met-/AA1-); and can also include similar optional combinations of VP2 (Met+/AA1) and VP2 (Met-/AA1-).

Additional AAV Sequences

In some embodiments, the AAV capsid variant, comprises immediately subsequent to position 448, 449, 452, 453, 455, numbered relative to SEQ ID NO: 138 or corresponding to equivalent positions in any other AAV serotype (e.g., AAV1, AAV2, AAV3, AAV3b, AAV4, AAV5, AAV6, AAV7, AAV8, AAVrh8, AAVrh10, AAVrh32.33, AAVrh74, SEQ ID NO: 1, SEQ ID NO: 11, PHP.N, PHP.B, or an AAV serotype as provided in Table 6 of WO 2021/230987 (the contents of which are hereby incorporated by reference in their entirety)), at least 3, 4, 5, 6, 7, 8, 9, 10, 11, 12, or 13 consecutive amino acids of any of amino acid sequence provided in Tables 1, 2A, 2B, 13-19. In some embodiments, the at least 3, 4, 5, 6, 7, 8, 9, 10, 11, 12, or 13 consecutive amino acids of any of amino acid sequence provided in Tables 1, 2A, 2B, 13-19 replaces at least one, two, three, four, five, six, seven, eight, nine, ten, or all of positions K449, T450, I451, N452, G453, S454, G455, Q456, N457, Q458, and/or Q459, numbered according to SEQ ID NO: 138 or corresponding to equivalent positions in any other AAV serotype (e.g., AAV1, AAV2, AAV3, AAV3b, AAV4, AAV5, AAV6, AAV7, AAV8, AAVrh8, AAVrh10, AAVrh32.33, AAVrh74, SEQ ID NO: 1, SEQ ID NO: 11, PHP.N, PHP.B, or an AAV serotype as provided in Table 6 of WO 2021/230987 (the contents of which are hereby incorporated by reference in their entirety). In some embodiments, the at least 3, 4, 5, 6, 7, 8, 9, 10, 11, 12, or 13 consecutive amino acids of any of amino acid sequence provided in Tables 1, 2A, 2B, 13-19 replaces positions S454, G455, or both positions S454 and G455, numbered according to SEQ ID NO: 138 or corresponding to equivalent positions in any other AAV serotype (e.g., AAV1, AAV2, AAV3, AAV3b, AAV4, AAV5, AAV6, AAV7, AAV8, AAVrh8, AAVrh10, AAVrh32.33, AAVrh74, SEQ ID NO: 1, SEQ ID NO: 11, PHP.N, PHP.B, or an AAV serotype as provided in Table 6 of WO 2021/230987 (the contents of which are hereby incorporated by reference in their entirety). In some embodiments, the AAV capsid variant comprises an amino acid other than the wild-type, e.g., native, amino acid, at one, two, three, four, five, six, seven, eight, nine or all of positions T450, I451, N452, G453, S454, G455, Q456, N457, Q458, and/or Q459, numbered according to SEQ ID NO: 138 or corresponding to equivalent positions in any other AAV serotype (e.g., AAV1, AAV2, AAV3, AAV3b, AAV4, AAV5, AAV6, AAV7, AAV8, AAVrh8, AAVrh10, AAVrh32.33, AAVrh74, SEQ ID NO: 1, SEQ ID NO: 11, PHP.N, PHP.B, or an AAV serotype as provided in Table 6 of WO 2021/230987 (the contents of which are hereby incorporated by reference in their entirety). In some embodiments, the AAV capsid variant comprises an amino acid other than the wild-type, e.g., native, amino acid, at position S454, G455, or both positions S454 and G455, numbered according to SEQ ID NO: 138 or corresponding to equivalent positions in any other AAV serotype (e.g., AAV1, AAV2, AAV3, AAV3b, AAV4, AAV5, AAV6, AAV7, AAV8, AAVrh8, AAVrh10, AAVrh32.33, AAVrh74, SEQ ID NO: 1, SEQ ID NO: 11, PHP.N, PHP.B, or an AAV serotype as provided in Table 6 of WO 2021/230987 (the contents of which are hereby incorporated by reference in their entirety)). In some embodiments, the AAV capsid variant comprises a modification, e.g., substitution, at one, two, three, four, five, six, seven, eight, nine, ten or all of positions K449, T450, I451, N452, G453, S454, G455, Q456, N457, Q458, and/or Q459, numbered according to SEQ ID NO: 138 or corresponding to equivalent positions in any other AAV serotype (e.g., AAV1, AAV2, AAV3, AAV3b, AAV4, AAV5, AAV6, AAV7, AAV8, AAVrh8, AAVrh10, AAVrh32.33, AAVrh74, SEQ ID NO: 1, SEQ ID NO: 11, PHP.N, PHP.B, or an AAV serotype as provided in Table 6 of WO 2021/230987 (the contents of which are hereby incorporated by reference in their entirety). In some embodiments, the AAV capsid variant comprises a modification, e.g., substitution, at position S454, G455, or both positions S454 and G455, numbered according to SEQ ID NO: 138 or corresponding to equivalent positions in any other AAV serotype (e.g., AAV1, AAV2, AAV3, AAV3b, AAV4, AAV5, AAV6, AAV7, AAV8, AAVrh8, AAVrh10, AAVrh32.33, AAVrh74, SEQ ID NO: 1, SEQ ID NO: 11, PHP.N, PHP.B, or an AAV serotype as provided in Table 6 of WO 2021/ 230987 (the contents of which are hereby incorporated by reference in their entirety).

In some embodiments, an AAV capsid polypeptide or AAV capsid variant described herein may comprise a VOY101 capsid polypeptide, an AAVPHP.B (PHP.B) capsid polypeptide, a AAVPHP.N (PHP.N) capsid polypeptide, an AAV1 capsid polypeptide, an AAV2 capsid polypeptide, an AAV5 capsid polypeptide, an AAV9 capsid polypeptide, an AAV9 K449R capsid polypeptide, an AAVrh10 capsid polypeptide, or a functional variant thereof. In some embodiments, the AAV capsid polypeptide, e.g., AAV capsid variant, comprises an amino acid sequence of any of the AAV capsid polypeptides in Table 6, or an amino acid sequence substantially identical (e.g., having at least 70%, 75%, 80%, 85%, 90%, 92%, 95%, 97%, 98%, or 99% sequence identity) thereto. In some embodiments, the nucleotide sequence encoding the AAV capsid polypeptide comprises any one of the nucleotide sequences in Table 6, or a nucleotide sequence substantially identical (e.g., having at least 70%, 75%, 80%, 85%, 90%, 92%, 95%, 97%, 98%, or 99% sequence identity) thereto.

In some embodiments, an AAV capsid polypeptide or an AAV capsid variant described herein comprises the amino acid sequence of SEQ ID NO: 138 or an amino acid sequence substantially identical (e.g., having at least 70%, 75%, 80%, 85%, 90%, 92%, 95%, 97%, 98%, or 99% sequence identity) thereto. In some embodiments the AAV capsid polypeptide or the AAV capsid variant, comprises an amino acid sequence comprising at least one, two, or three modifications, e.g., substitutions (e.g., conservative substitutions), but no more than 30, 20, or 10 modifications, e.g., substitutions (e.g., conservative substitutions), relative to the amino acid sequence of SEQ ID NO: 138. In some embodiments, the AAV capsid polypeptide or the AAV capsid variant, comprises an amino acid sequence encoded by the nucleotide sequence of SEQ ID NO: 137 or a nucleotide sequence substantially identical (e.g., having at least 70%, 75%, 80%, 85%, 90%, 92%, 95%, 97%, 98%, or 99% sequence identity) thereto. In some embodiments, the nucleotide sequence encoding the AAV capsid polypeptide or the AAV capsid variant comprises the nucleotide sequence of SEQ ID NO: 137 or a nucleotide sequence substantially identical (e.g., having at least 70%, 75%, 80%, 85%, 90%, 92%, 95%, 97%, 98%, or 99% sequence identity) thereto. In some embodiments, the AAV capsid polypeptide or the AAV capsid variant, comprises substitution at position K449, e.g., a K449R substitution, numbered according to SEQ ID NO: 138.

In some embodiments, the AAV capsid polypeptide or the AAV capsid variant, comprises a peptide comprising the amino acid sequence of TLAVPFK (SEQ ID NO: 4680). In some embodiments, the peptide is present immediately subsequent to position 588, relative to a reference sequence numbered according to SEQ ID NO: 138. In some embodiments, the capsid polypeptide comprises the amino acid substitutions of A587D and Q588G, numbered according to SEQ ID NO: 138.

In some embodiments, the AAV capsid polypeptide or the AAV capsid variant comprises the amino acid substitution of K449R, numbered according to SEQ ID NO: 138; and a peptide comprising the amino acid sequence of TLAVPFK (SEQ ID NO: 4680), wherein the peptide is present immediately subsequent to position 588, relative to a reference sequence numbered according to SEQ ID NO: 138.

In some embodiments, the AAV capsid polypeptide or the AAV capsid variant comprises the amino acid substitution of K449R, numbered according to SEQ ID NO: 138; an peptide comprising the amino acid sequence of TLAVPFK (SEQ ID NO: 4680), wherein the insert is present immediately subsequent to position 588, relative to a reference sequence numbered according to SEQ ID NO: 138; and the amino acid substitutions of A587D and Q588G, numbered according to SEQ ID NO: 138.

In some embodiments, the AAV capsid polypeptide or the AAV capsid variant comprises a peptide comprising the amino acid sequence of TLAVPFK (SEQ ID NO: 4680), wherein the insert is present immediately subsequent to position 588, relative to a reference sequence numbered according to SEQ ID NO: 138; and the amino acid substitutions of A587D and Q588G, numbered according to SEQ ID NO: 138.

In some embodiments, the AAV capsid polypeptide or the AAV capsid variant comprises the amino acid sequence of SEQ ID NO: 11 or an amino acid sequence substantially identical (e.g., having at least 70%, 75%, 80%, 85%, 90%, 92%, 95%, 97%, 98%, or 99% sequence identity) thereto. In some embodiments the AAV capsid polypeptide or the AAV capsid variant, comprises an amino acid sequence comprising at least one, two, or three modifications, e.g., substitutions (e.g., conservative substitutions), but no more than 30, 20, or 10 modifications, e.g., substitutions (conservative substitutions), relative to the amino acid sequence of SEQ ID NO: 11, optionally wherein position 449 is not R.

In some embodiments, the AAV capsid polypeptide or AAV capsid variant, comprises the amino acid sequence of SEQ ID NO: 1 or an amino acid sequence substantially identical (e.g., having at least 70%, 75%, 80%, 85%, 90%, 92%, 95%, 97%, 98%, or 99% sequence identity) thereto. In some embodiments the AAV capsid polypeptide or the AAV capsid variant, comprises an amino acid sequence comprising at least one, two, or three modifications, e.g., substitutions (e.g., conservative substitutions), but no more than 30, 20, or 10 modifications, e.g., substitutions (e.g., conservative substitutions), relative to the amino acid sequence of SEQ ID NO: 1.

TABLE 6

AAV Sequences

| Serotype | SEQ ID NO: | Sequence |
|---|---|---|
| VQY101 | 1 | MAADGYLPDWLEDNLSEGIREWWALKPGAPQPKANQQHQDNARGLVLPGYKYLGPGNGLD<br>KGEPVNAADAAALEHDKAYDQQLKAGDNPYLKYNHADAEFQERLKEDTSFGGNLGRAVFQ<br>AKKRLLEPLGLVEEAAKTAPGKKRPVEQSPQEPDSSAGIGKSGAQPAKKRLNFGQTGDTE<br>SVPDPQPIGEPPAAPSGVGSLTMASGGGAPVADNNEGADGVGSSSGNWHCDSQWLGDRVI<br>TTSTRTWALPTYNNHLYKQISNSTSGGSSNDNAYFGYSTPWGYFDFNRFHCHFSPRDWQR<br>LINNNWGFRPKRLNFKLFNIQVKEVTDNNGVKTIANNLTSTVQVFTDSDYQLPYVLGSAH<br>EGCLPPFPADVFMIPQYGYLTLNDGSQAVGRSSFYCLEYFPSQMLRTGNNFQFSYEFENV<br>PFHSSYAHSQSLDRLMNPLIDQYLYYLSKTINGSGQNQQTLKFSVAGPSNMAVQGRNYIP<br>GPSYRQQRVSTTVTQNNNSEFAWPGASSWALNGRNSLMNPGPAMASHKEGEDRFFPLSGS<br>LIFGKQGTGRDNVDADKVMITNEEEIKTTNPVATESYGQVATNHQSDGTLAVPFKAQAQT<br>GWVQNQGILPGMVWQDRDVYLQGPIWAKIPHTDGNFHPSPLMGGFGMKHPPPQILIKNTP<br>VPADPPTAFNKDKLNSFITQYSTGQVSVEIEWELQKENSKRWNPEIQYTSNYYKSNNVEF<br>AVNTEGVYSEPRPIGTRYLTRNL |
| AAV9/hu.14 K449R | 11 | MAADGYLPDWLEDNLSEGIREWWALKPGAPQPKANQQHQDNARGLVLPGYKYLGPGNGLD<br>KGEPVNAADAAALEHDKAYDQQLKAGDNPYLKYNHADAEFQERLKEDTSFGGNLGRAVFQ<br>AKKRLLEPLGLVEEAAKTAPGKKRPVEQSPQEPDSSAGIGKSGAQPAKKRLNFGQTGDTE<br>SVPDPQPIGEPPAAPSGVGSLTMASGGGAPVADNNEGADGVGSSSGNWHCDSQWLGDRVI<br>TTSTRTWALPTYNNHLYKQISNSTSGGSSNDNAYFGYSTPWGYFDFNRFHCHFSPRDWQR<br>LINNNWGFRPKRLNFKLFNIQVKEVTDNNGVKTIANNLTSTVQVFTDSDYQLPYVLGSAH<br>EGCLPPFPADVEMIPQYGYLTLNDGSQAVGRSSFYCLEYFPSQMLRTGNNFQFSYEFENV<br>PFHSSYAHSQSLDRLMNPLIDQYLYYLSRTINGSGQNQQTLKFSVAGPSNMAVQGRNYIP<br>GPSYRQQRVSTTVTQNNNSEFAWPGASSWALNGRNSLMNPGPAMASHKEGEDRFFPLSGS<br>LIFGKQGTGRDNVDADKVMITNEEEIKTTNPVATESYGQVATNHQSAQAQAQTGWVQNQG<br>ILPGMVWQDRDVYLQGPIWAKIPHTDGNFHPSPLMGGFGMKHPPPQILIKNTPVPADPPT<br>AFNKDKLNSFITQYSTGQVSVEIEWELQKENSKRWNPEIQYTSNYYKSNNVEFAVNTEGV<br>YSEPRPIGTRYLTRNL |
| AAV9/hu.14 WT (amino acid) | 138 | MAADGYLPDWLEDNLSEGIREWWALKPGAPQPKANQQHODNARGLVLPGYKYLGPGNGLD<br>KGEPVNAADAAALEHDKAYDQQLKAGDNPYLKYNHADAEFQERLKEDTSFGGNLGRAVFQ<br>AKKRLLEPLGLVEEAAKTAPGKKRPVEQSPQEPDSSAGIGKSGAQPAKKRLNFGQTGDTE<br>SVPDPQPIGEPPAAPSGVGSLTMASGGGAPVADNNEGADGVGSSSGNWHCDSQWLGDRVI<br>TTSTRTWALPTYNNHLYKQISNSTSGGSSNDNAYFGYSTPWGYFDFNRFHCHFSPRDWQR<br>LINNNWGFRPKRLNFKLFNIQVKEVTDNNGVKTIANNLTSTVQVFTDSDYQLPYVLGSAH<br>EGCLPPFPADVFMIPQYGYLTLNDGSQAVGRSSFYCLEYFPSQMLRTGNNFQFSYEFENV<br>PFHSSYAHSQSLDRLMNPLIDQYLYYLSKTINGSGQNQQTLKFSVAGPSNMAVQGRNYIP<br>GPSYRQQRVSTTVTQNNNSEFAWPGASSWALNGRNSLMNPGPAMASHKEGEDRFFPLSGS<br>LIFGKQGTGRDNVDADKVMITNEEEIKTTNPVATESYGQVATNHQSAQAQAQTGWVQNQG<br>ILPGMVWQDRDVYLQGPIWAKIPHTDGNFHPSPLMGGFGMKHPPPQILIKNTPVPADPPT<br>AFNKDKLNSFITQYSTGQVSVEIEWELQKENSKRWNPEIQYTSNYYKSNNVEFAVNTEGV<br>YSEPRPIGTRYLTRNL |
| AAV9/hu.14 WT (DNA) | 137 | ATGGCTGCCGATGGTTATCTTCCAGATTGGCTCGAGGACAACCTTAGTGAAGGAATTCGC<br>GAGTGGTGGGCTTTGAAACCTGGAGCCCCTCAACCCAAGGCAAATCAACAACATCAAGAC<br>AACGCTCGAGGTCTTGTGCTTCCGGGTTACAAATACCTTGGACCCGGCAACGGACTCGAC<br>AAGGGGGAGCCGGTCAACGCAGCAGACGCGGCGGCCCTCGAGCACGACAAGGCCTACGAC<br>CAGCAGCTCAAGGCCGGAGACAACCCGTACCTCAAGTACAACCACGCCGACGCCGAGTTC<br>CAGGAGCGGCTCAAAGAAGATACGTCTTTTGGGGGCAACCTCGGGCGAGCAGTCTTCCAG<br>GCCAAAAAGAGGCTTCTTGAACCTCTTGGTCTGGTTGAGGAAGCGGCTAAGACGGCTCCT<br>GGAAAGAAGAGGCCTGTAGAGCAGTCTCCTCAGGAACCGGACTCCTCCGCGGGTATTGGC<br>AAATCGGGTGCACAGCCCGCTAAAAAGAGACTCAATTTCGGTCAGACTGGCGACACAGAG<br>TCAGTCCCAGACCCTCAACCAATCGGAGAACCTCCCGCAGCCCCCTCAGGTGTGGGATCT<br>CTTACAATGGCTTCAGGTGGTGGCGCACCAGTGGCAGACAATAACGAAGGTGCCGATGGA<br>GTGGGTAGTTCCTCGGGAAATTGGCATTGCGATTCCCAATGGCTGGGGGACAGAGTCATC<br>ACCACCAGCACCCGAACCTGGGCCCTGCCCACCTACAACAATCACCTCTACAAGCAAATC<br>TCCAACAGCACATCTGGGGGATCTTCAAATGACAACGCCTACTTCGGCTACAGCACCCCC<br>TGGGGGTATTTTGACTTCAACAGATTCCACTGCCACTTCTCACCACGTGACTGGCAGCGA<br>CTCATCAACAACAACTGGGGATTCCGGCCTAAGCGACTCAACTTCAAGCTCTTCAACATT<br>CAGGTCAAAGAGGTTACGGACAACAATGGAGTCAAGACCATCGCCAATAACCTTACCAGC<br>ACGGTCCAGGTCTTCACGGACTCAGACTATCAGCTCCCGTACGTGCTCGGGTCGGCTCAC<br>GAGGGCTGCCTCCCGCCCTTCCCAGCGGACGTTTTCATGATTCCTCAGTACGGGTATCTG<br>ACGCTTAATGATGGAAGCCAGGCCGTGGGTCGTTCGTCCTTTTACTGCCTGGAATATTTC<br>CCGTCGCAAATGCTAAGAACGGGTAACAACTTCCAGTTCAGCTACGAGTTTGAGAACGTA<br>CCTTTTCATAGCAGCTACGCTCACAGCCAAAGCCTGGACCGACTAATGAATCCACTCATC<br>GACCAATACTTGTACTATCTCTCAAAGACTATTAACGGTTCTGGACAGAATCAACAAACG<br>CTAAAATTCAGTGTGGCCGGACCCAGCAACATGGCTGTCCAGGGAAGAAACTACATACCT<br>GGACCCAGCTACCGACAACAACGTGTCTCAACCACTGTGACTCAAAACAACAACAGCGAA |

TABLE 6-continued

AAV Sequences

| Serotype | SEQ ID NO: | Sequence |
|---|---|---|
| | | TTTGCTTGGCCTGGAGCTTCTTCTTGGGCTCTCAATGGACGTAATAGCTTGATGAATCCT<br>GGACCTGCTATGGCCAGCCACAAAGAAGGAGAGGACCGTTTCTTTCCTTTGTCTGGATCT<br>TTAATTTTTGGCAAACAAGGAACTGGAAGAGACAACGTGGATGCGGACAAAGTCATGATA<br>ACCAACGAAGAAGAAATTAAAACTACTAACCCGGTAGCAACGGAGTCCTATGGACAAGTG<br>GCCACAAACCACCAGAGTGCCCAAGCACAGGCGCAGACCGGCTGGGTTCAAAACCAAGGA<br>ATACTTCCGGGTATGGTTTGGCAGGACAGAGATGTGTACCTGCAAGGACCCATTTGGGCC<br>AAAATTCCTCACACGGACGGCAACTTTCACCCTTCTCCGCTGATGGGAGGGTTTGGAATG<br>AAGCACCCGCCTCCTCAGATCCTCATCAAAAACACACCTGTACCTGCGGATCCTCCAACG<br>GCCTTCAACAAGGACAAGCTGAACTCTTTCATCACCCAGTATTCTACTGGCCAAGTCAGC<br>GTGGAGATCGAGTGGGAGCTGCAGAAGGAAAACAGCAAGCGCTGGAACCCGGAGATCCAG<br>TACACTTCCAACTATTACAAGTCTAATAATGTTGAATTTGCTGTTAATACTGAAGGTGTA<br>TATAGTGAACCCCGCCCCATTGGCACCAGATACCTGACTCGTAATCTGTAA |

Viral Genome of the AAV Particle

In some embodiments, an AAV particle as described herein comprising an AAV capsid variant described herein, may be used for the delivery of a viral genome to a tissue (e.g., CNS, DRG, and/or muscle). In some embodiments, an AAV particle comprising an AAV capsid variant described herein can be used for delivery of a viral genome to a tissue or cell, e.g., CNS, DRG, or muscle cell or tissue. In some embodiments, an AAV particle of the present disclosure is a recombinant AAV particle. In some embodiments, an AAV particle of the present disclosure is an isolated AAV particle.

The viral genome may encode any payload, such as but not limited to a polypeptide (e.g., a therapeutic polypeptide), an antibody, an enzyme, an RNAi agent and/or components of a gene editing system. In one embodiment, the AAV particles described herein are used to deliver a payload to cells of the CNS, after intravenous delivery. In another embodiment, the AAV particles described herein are used to deliver a payload to cells of the DRG, after intravenous delivery. In some embodiments, the AAV particles described herein are used to deliver a payload to cells of a muscle, e.g., a heart muscle, after intravenous delivery.

In some embodiments, a viral genome of an AAV particle comprising an AAV capsid variant, as described herein, comprises a nucleotide sequence comprising a transgene encoding a payload. In some embodiments, the viral genome comprises an inverted terminal repeat sequence (ITR). In some embodiments, the viral genome comprises two ITR sequences, one at the 5' end of the viral genome (e.g., 5' relative to the encoded payload) and one at the 3' end of the viral genome (e.g., 3' relative to the encoded payload). In some embodiments, a viral genome of an AAV particle, e.g., an AAV particle comprising an AAV capsid variant described herein, may comprise a regulatory element (e.g., promoter), untranslated regions (UTR), a miR binding site, a polyadenylation sequence (polyA), a filler or stuffer sequence, an intron, and/or a linker sequence, e.g., for enhancing transgene expression.

In some embodiments, the viral genome components are selected and/or engineered for expression of the payload in a target tissue (e.g., CNS, muscle, or DRG).

Viral Genome Component: Inverted Terminal Repeats (ITRs)

In some embodiments, the AAV particle comprising an AAV capsid variant described herein comprises a viral genome comprising an ITR and a transgene encoding a payload. In some embodiments, the viral genome comprises two ITRs. In some embodiments, the two ITRs flank the nucleotide sequence encoding the payload at the 5' and 3' ends. In some embodiments, the ITRs function as origins of replication comprising recognition sites for replication. In some embodiments, the ITRs comprise sequence regions which can be complementary and symmetrically arranged. In some embodiments, the ITRs incorporated into viral genomes as described herein may be comprised of naturally occurring polynucleotide sequences or recombinantly derived polynucleotide sequences.

In some embodiments, the ITR may be from the same serotype as the capsid polypeptide, e.g., capsid variant, selected from any of the known serotypes, or a variant thereof. In some embodiments, the ITR may be of a different serotype than the capsid. In some embodiments, the viral genome comprises two ITR sequence regions, wherein the ITRs are of the same serotype as one another. In some embodiments, the viral genome comprises two ITR sequence regions, wherein the ITRs are of different serotypes. Non-limiting examples include zero, one or both of the ITRs having the same serotype as the capsid. In one embodiment both ITRs of the viral genome of the AAV particle are AAV2 ITRs.

Independently, each ITR may be about 100 to about 150 nucleotides in length. An ITR may be about 100-105 nucleotides in length, 106-110 nucleotides in length, 111-115 nucleotides in length, 116-120 nucleotides in length, 121-125 nucleotides in length, 126-130 nucleotides in length, 131-135 nucleotides in length, 136-140 nucleotides in length, 141-145 nucleotides in length or 146-150 nucleotides in length. In one embodiment, the ITRs are 140-142 nucleotides in length. Non-limiting examples of ITR length are 102, 105, 130, 140, 141, 142, 145 nucleotides in length.

Viral Genome Component: Promoters

In some embodiments, viral genome of an AAV particle described herein comprises at least one element to enhance the payload target specificity and expression (See e.g., Powell et al. Viral Expression Cassette Elements to Enhance Transgene Target Specificity and Expression in Gene Therapy, 2015; the contents of which are herein incorporated by reference in their entirety). Non-limiting examples of elements to enhance payload target specificity and expression include promoters, endogenous miRNAs, post-transcriptional regulatory elements (PREs), polyadenylation (PolyA) signal sequences and upstream enhancers (USEs), CMV enhancers and introns.

In some embodiments, an AAV particle comprising an AAV capsid variant described herein comprises a viral genome comprising a nucleic acid comprising a transgene encoding a payload, wherein the transgene is operably linked to a promoter. In some embodiments, the promoter is a species specific promoter, an inducible promoter, a tissue-specific promoter, or a cell cycle-specific promoter (e.g., a promoter as described in Parr et al., Nat. Med. 3:1145-9 (1997); the contents of which are herein incorporated by reference in their entirety).

In some embodiments, the Promoter may be naturally occurring or non-naturally occurring. Non-limiting examples of promoters include those derived from viruses, plants, mammals, or humans. In some embodiments, the promoters may be those derived from human cells or systems. In some embodiments, the promoter may be truncated or mutated, e.g., a promoter variant.

In some embodiments, the promoter is a ubiquitous promoter, e.g., capable of expression in multiple tissues. In some embodiments the promoter is an human elongation factor 1α-subunit (EF1α) promoter, the cytomegalovirus (CMV) immediate-early enhancer and/or promoter, the chicken β-actin (CBA) promoter and its derivative CAG, β glucuronidase (GUSB) promoter, or ubiquitin C (UBC) promoter. In some embodiments, the promoter is a cell or tissue specific promoter, e.g., capable of expression in tissues or cells of the central or peripheral nervous systems, targeted regions within (e.g., frontal cortex), and/or sub-sets of cells therein (e.g., excitatory neurons). In some embodiments, the promoter is a cell-type specific promoters capable of expression of a payload in excitatory neurons (e.g., glutamatergic), inhibitory neurons (e.g., GABA-ergic), neurons of the sympathetic or parasympathetic nervous system, sensory neurons, neurons of the dorsal root ganglia, motor neurons, or supportive cells of the nervous systems such as microglia, glial cells, astrocytes, oligodendrocytes, and/or Schwann cells.

In some embodiments, the promoter is a liver specific promoter (e.g., hAAT, TBG), skeletal muscle specific promoter (e.g., desmin, MCK, C512), B cell promoter, monocyte promoter, leukocyte promoter, macrophage promoter, pancreatic acinar cell promoter, endothelial cell promoter, lung tissue promoter, and/or cardiac or cardiovascular promoter (e.g., αMHC, cTnT, and CMV-MLC2k).

In some embodiments, the promoter is a tissue-specific promoter for payload expression in a tissue or cell of the central nervous system. In some embodiments, the promoter is a synapsin (Syn) promoter, glutamate vesicular transporter (VGLUT) promoter, vesicular GABA transporter (VGAT) promoter, parvalbumin (PV) promoter, sodium channel Na, 1.8 promoter, tyrosine hydroxylase (TH) promoter, choline acetyltransferase (ChaT) promoter, methyl-CpG binding protein 2 (MeCP2) promoter, $Ca^{2+}$/calmodulin-dependent protein kinase II (CaMKII) promoter, metabotropic glutamate receptor 2 (mGluR2) promoter, neurofilament light (NFL) or heavy (NFH) promoter, neuron-specific enolase (NSE) promoter, β-globin minigene nβ2 promoter, preproenkephalin (PPE) promoter, enkephalin (Enk) promoter, and excitatory amino acid transporter 2 (EAAT2) promoter, or a fragment thereof. In some embodiments, the promoter is a cell-type specific promoter capable of expression in an astrocyte, e.g., a glial fibrillary acidic protein (GFAP) promoter and a EAAT2 promoter, or a fragment thereof. In some embodiments, the promoter is a cell-type specific promoter capable of expression in an oligodendrocyte, e.g., a myelin basic protein (MBP) promoter or a fragment thereof.

In some embodiments, the promoter is a GFAP promoter. In some embodiments, the promoter is a synapsin (syn or syn1) promoter, or a fragment thereof.

In some embodiments, the promoter comprises an insulin promoter or a fragment thereof.

In some embodiments, the promoter of the viral genome described herein (e.g., comprised within an AAV particle comprising an AAV capsid variant described herein) comprises an EF-1α promoter or variant thereof, e.g., as provided in Table 8. In some embodiments, the EF-1α promoter comprises the nucleotide sequence of any one of SEQ ID NOs: 987, 988, 990, 991, 995, 996, 998-1007 or any one of the sequences provided in Table 8, a nucleotide sequence comprising at least one, two, or three but no more than four modifications, e.g., substitutions, relative to the nucleotide sequence of SEQ ID NOs: 987, 988, 990, 991, 995, 996, 998-1007 or any one of the sequences provided in Table 8, or a nucleotide sequence with at least 70% (e.g., 80, 85%, 90%, 95%, 96%, 97%, 98%, or 99%) sequence identity to any one of SEQ ID NOs: 987, 988, 990, 991, 995, 996, 998-1007 or any one of the sequences provided in Table 8.

TABLE 8

Exemplary Promoter Variants

| Description | Sequences | SEQ ID NO: |
|---|---|---|
| EF1a Promoter (intron underlined) | CGTGAGGCTCCGGTGCCCGTCAGTGGGCAGAGCGCACATCGCCCACAGTCCCCGA GAAGTTGGGGGGAGGGGTCGGCAATTGAACCGGTGCCTAGAGAAGGTGGCGCGGG GTAAACTGGGAAAGTGATGTCGTGTACTGGCTCCGCCTTTTTCCCGAGGGTGGGG GAGAACCGTATATAAGTGCAGTAGTCGCCGTGAACGTTCTTTTTCGCAACGGGTT TGCCGCCAGAACACAGGTAAGTGCCGTGTGTGGTTCCCGCGGGCCTGGCCTCTTT ACGGGTTATGGCCCTTGCGTGCCTTGAATTACTTCCACCTGGCTGCAGTACGTGA TTCTTGATCCCGAGCTTCGGGTTGGAAGTGGGTGGGAGAGTTCGAGGCCTTGCGC TTAAGGAGCCCCTTCGCCTCGTGCTTGAGTTGAGGCCTGGCCTGGGCGCTGGGGC CGCCGCGTGCGAATCTGGTGGCACCTTCGCGCCTGTCTCGCTGCTTTCGATAAGT CTCTAGCCATTTAAAATTTTTGATGACCTGCTGCGACGCTTTTTTTCTGGCAAGA TAGTCTTGTAAATGCGGGCCAAGATCTGCACACTGGTATTTCGGTTTTTGGGGCC GCGGGCGGCGACGGGGCCCGTGCGTCCCAGCGCACATGTTCGGCGAGGCGGGGCC TGCGAGCGCGGCCACCGAGAATCGGACGGGGGTAGTCTCAAGCTGGCCGGCCTGC TCTGGTGCCTGGCCTCGCGCCGCCGTGTATCGCCCCGCCCTGGGCGGCAAGGCTG GCCCGGTCGGCACCAGTTGCGTGAGCGGAAAGATGGCCGCTTCCCGGCCCTGCTG CAGGGAGCTCAAAATGGAGGACGCGGCGCTCGGGAGAGCGGGCGGGTGAGTCACC CACACAAAGGAAAAGGGCCTTTCCGTCCTCAGCCGTCGCTTCATGTGACTCCACG GAGTACCGGGCGCCGTCCAGGCACCTCGATTAGTTCTCGAGCTTTTGGAGTACGT CGTCTTTAGGTTGGGGGGAGGGGTTTTATGCGATGGAGTTTCCCCACACTGAGTG GGTGGAGACTGAAGTTAGGCCAGCTTGGCACTTGATGTAATTCTCCTTGGAATTT | 987 |

TABLE 8-continued

Exemplary Promoter Variants

| Description | Sequences | SEQ ID NO: |
|---|---|---|
| | GCCCTTTTTGAGTTTGGATCTTGGTTCATTCTCAAGCCTCAGACAGTGGTTCAAA<br>GTTTTTTTCTTCCATTTCAGGTGTCGTGA | |
| miniEF1a | GCCCGTCAGTGGGCAGAGCGCACATCGCCCACAGTCCCCGAGAAGTTGGGGGGAG<br>GGGTCGGCAATTGAACCGGTGCCTAGAGAAGGTGGCGCGGGGTAAACTGGGAAAG<br>TGATGTCGTGTACTGGCTCCGCCTTTTTCCCGAGGGTGGGGGAGAACCGTATATA<br>AGTGCAGTAGTCGCCGTGAACGTTCTTTTTCGCAACGGGTTTGCCGCCAGAACAC<br>GCGTAAG | 988 |
| Promoter Variant 1 | GCATG | |
| Promoter Variant 2 | GGTGGAGAAGAGCATG | 990 |
| Promoter Variant 3 | GTCATCACTGAGGTGGAGAAGAGCATG | 991 |
| Promoter Variant 4 | CGTGAG | |
| Promoter Variant 5 | GT | |
| Promoter Variant 6 | GCTCCGGT | |
| Promoter Variant 19 | GCCCGTCAGTGGGCAGAGCGCACATCGCCCACAGTCCCCGAGAAGTTGGGGGGAG<br>GGGTCGGCAATTGAACCGGTGCCTAGAGAAGGTGGCGCGGGGTAAACTGGGAAAG<br>TGATGTCGTGTACTGGCTCCGCCTTTTTCCCGAGGGTGGGGGAGAACCGTATATA<br>AGTGCAGTAGTCGCCGTGAACGTTCTTTTTCGCAACGGGTTTGCCGCCAGAACAC<br>AG | 995 |
| Promoter Variant 20 | GCCCGTCAGTGGGCAGAGCGCACATCGCCCACAGTCCCCGAGAAGTTGGGGGGAG<br>GGGTCGGCAATTGAACCGGTGCCTAGAGAAGGTGGCGCGGGGTAAACTGGGAAAG<br>TGATGTCGTGTACTGGCTCCGCCTTTTTCCCGAGGGTGGGGGAGAACCGTATATA<br>AGTGCAGTAGTCGCCGTGAACGTTCTTTTTCGCAACGGGTTTGCCGCCAGAACAC<br>GC | 996 |
| Promoter Variant 7 | GTAAG | |
| Promoter Variant 8 | GTGCCCGTCAGTGGGCAGAGCGCACATCGCCCACAGTCCCCGAGAAGTTGGGGGG<br>AGGGGTCGGCAATTGAACCGGTGCCTAGAGAAGGTGGCGCGGGGTAAACTGGGAA<br>AGTGATGTCGTGTACTGGCTCCGCCTTTTTCCCGAGGGTGGGGGAGAACCGTATA<br>TAAGTGCAGTAGTCGCCGTGAACGTTCTTTTTCGCAACGGGTTTGCCGCCAGAAC<br>ACGCGTAAG | 998 |
| Promoter Variant 9 | GCTCCGGTGCCCGTCAGTGGGCAGAGCGCACATCGCCCACAGTCCCCGAGAAGTT<br>GGGGGGAGGGGTCGGCAATTGAACCGGTGCCTAGAGAAGGTGGCGCGGGGTAAAC<br>TGGGAAAGTGATGTCGTGTACTGGCTCCGCCTTTTTCCCGAGGGTGGGGGAGAAC<br>CGTATATAAGTGCAGTAGTCGCCGTGAACGTTCTTTTTCGCAACGGGTTTGCCGC<br>CAGAACACGCGTAAG | 999 |
| Promoter Variant 10 | CGTGAGGCTCCGGTGCCCGTCAGTGGGCAGAGCGCACATCGCCCACAGTCCCCGA<br>GAAGTTGGGGGGAGGGGTCGGCAATTGAACCGGTGCCTAGAGAAGGTGGCGCGGG<br>GTAAACTGGGAAAGTGATGTCGTGTACTGGCTCCGCCTTTTTCCCGAGGGTGGGG<br>GAGAACCGTATATAAGTGCAGTAGTCGCCGTGAACGTTCTTTTTCGCAACGGGTT<br>TGCCGCCAGAACACGCGTAAG | 1000 |
| Promoter Variant 11 | CGTGAGGCTCCGGTGCCCGTCAGTGGGCAGAGCGCACATCGCCCACAGTCCCCGA<br>GAAGTTGGGGGGAGGGGTCGGCAATTGAACCGGTGCCTAGAGAAGGTGGCGCGGG<br>GTAAACTGGGAAAGTGATGTCGTGTACTGGCTCCGCCTTTTTCCCGAGGGTGGGG<br>GAGAACCGTATATAAGTGCAGTAGTCGCCGTGAACGTTCTTTTTCGCAACGGGTT<br>TGCCGCCAGAACACAG | 1001 |
| Promoter Variant 12 | GCATGCGTGAGGCTCCGGTGCCCGTCAGTGGGCAGAGCGCACATCGCCCACAGTC<br>CCCGAGAAGTTGGGGGGAGGGGTCGGCAATTGAACCGGTGCCTAGAGAAGGTGGC<br>GCGGGGTAAACTGGGAAAGTGATGTCGTGTACTGGCTCCGCCTTTTTCCCGAGGG<br>TGGGGGAGAACCGTATATAAGTGCAGTAGTCGCCGTGAACGTTCTTTTTCGCAAC<br>GGGTTTGCCGCCAGAACACGCGTAAG | 1002 |
| Promoter Variant 13 | GCATGCGTGAGGCTCCGGTGCCCGTCAGTGGGCAGAGCGCACATCGCCCACAGTC<br>CCCGAGAAGTTGGGGGGAGGGGTCGGCAATTGAACCGGTGCCTAGAGAAGGTGGC<br>GCGGGGTAAACTGGGAAAGTGATGTCGTGTACTGGCTCCGCCTTTTTCCCGAGGG | 1003 |

TABLE 8-continued

Exemplary Promoter Variants

| Description | Sequences | SEQ ID NO: |
|---|---|---|
| | TGGGGGAGAACCGTATATAAGTGCAGTAGTCGCCGTGAACGTTCTTTTTCGCAAC GGGTTTGCCGCCAGAACACAG | |
| Promoter Variant 14 | GGTGGAGAAGAGCATGCGTGAGGCTCCGGTGCCCGTCAGTGGGCAGAGCGCACAT CGCCCACAGTCCCCGAGAAGTTGGGGGGAGGGGTCGGCAATTGAACCGGTGCCTA GAGAAGGTGGCGCGGGGTAAACTGGGAAAGTGATGTCGTGTACTGGCTCCGCCTT TTTCCCGAGGGTGGGGGAGAACCGTATATAAGTGCAGTAGTCGCCGTGAACGTTC TTTTTCGCAACGGGTTTGCCGCCAGAACACGCGTAAG | 1004 |
| Promoter Variant 15 | GGTGGAGAAGAGCATGCGTGAGGCTCCGGTGCCCGTCAGTGGGCAGAGCGCACAT CGCCCACAGTCCCCGAGAAGTTGGGGGGAGGGGTCGGCAATTGAACCGGTGCCTA GAGAAGGTGGCGCGGGGTAAACTGGGAAAGTGATGTCGTGTACTGGCTCCGCCTT TTTCCCGAGGGTGGGGGAGAACCGTATATAAGTGCAGTAGTCGCCGTGAACGTTC TTTTTCGCAACGGGTTTGCCGCCAGAACACAG | 1005 |
| Promoter Variant 16 | GTCATCACTGAGGTGGAGAAGAGCATGCGTGAGGCTCCGGTGCCCGTCAGTGGGC AGAGCGCACATCGCCCACAGTCCCCGAGAAGITGGGGGGAGGGGTCGGCAATTGA ACCGGTGCCTAGAGAAGGTGGCGCGGGGTAAACTGGGAAAGTGATGTCGTGTACT GGCTCCGCCTTTTTCCCGAGGGTGGGGGAGAACCGTATATAAGTGCAGTAGTCGC CGTGAACGTTCTTTTTCGCAACGGGTTTGCCGCCAGAACACGCGTAAG | 1006 |
| Promoter Variant 18 | GTCATCACTGAGGTGGAGAAGAGCATGCGTGAGGCTCCGGTGCCCGTCAGTGGGC AGAGCGCACATCGCCCACAGTCCCCGAGAAGTTGGGGGGAGGGGTCGGCAATTGA ACCGGTGCCTAGAGAAGGTGGCGCGGGGTAAACTGGGAAAGTGATGTCGTGTACT GGCTCCGCCTTTTTCCCGAGGGTGGGGGAGAACCGTATATAAGTGCAGTAGTCGC CGTGAACGTTCTTTTTCGCAACGGGTTTGCCGCCAGAACACAG | 1007 |

Viral Genome Component: Untranslated Regions (UTRs)

In some embodiments, wild type untranslated regions (UTRs) of a gene are transcribed but not translated. Generally, the 5' UTR starts at the transcription start site and ends at the start codon and the 3' UTR starts immediately following the stop codon and continues until the termination signal for transcription.

Features typically found in abundantly expressed genes of specific target organs (e.g., CNS tissue, muscle, or DRG) may be engineered into UTRs to enhance stability and protein production. As a non-limiting example, a 5' UTR from mRNA normally expressed in the brain (e.g., huntingtin) may be used in the viral genomes of the AAV particles described herein to enhance expression in neuronal cells or other cells of the central nervous system.

While not wishing to be bound by theory, wild-type 5' untranslated regions (UTRs) include features which play roles in translation initiation. Kozak sequences, which are commonly known to be involved in the process by which the ribosome initiates translation of many genes, are usually included in 5' UTRs. Kozak sequences have the consensus CCR(A/G)CCAUGG, where R is a purine (adenine or guanine) three bases upstream of the start codon (ATG), which is followed by another 'G'.

In one embodiment, the 5'UTR in the viral genome includes a Kozak sequence.

In one embodiment, the 5'UTR in the viral genome does not include a Kozak sequence.

While not wishing to be bound by theory, wild-type 3' UTRs are known to have stretches of Adenosines and Uridines embedded therein. These AU rich signatures are particularly prevalent in genes with high rates of turnover. Based on their sequence features and functional properties, the AU rich elements (AREs) can be separated into three classes (Chen et al, 1995, the contents of which are herein incorporated by reference in its entirety): Class I AREs, such as, but not limited to, c-Myc and MyoD, contain several dispersed copies of an AUUUA motif within U-rich regions. Class II AREs, such as, but not limited to, GM-CSF and TNF-α, possess two or more overlapping UUAUUUA(U/A)(U/A) nonamers. Class III ARES, such as, but not limited to, c-Jun and Myogenin, are less well defined. These U rich regions do not contain an AUUUA motif. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

Introduction, removal or modification of 3' UTR AU rich elements (AREs) can be used to modulate the stability of a polynucleotide. When engineering specific polynucleotides, e.g., payload regions of viral genomes, one or more copies of an ARE can be introduced to make polynucleotides less stable and thereby curtail translation and decrease production of the resultant protein. Likewise, AREs can be identified and removed or mutated to increase the intracellular stability and thus increase translation and production of the resultant protein.

In one embodiment, the 3' UTR of the viral genome may include an oligo(dT) sequence for templated addition of a poly-A tail.

In one embodiment, the viral genome may include at least one miRNA seed, binding site or full sequence. microRNAs (or miRNA or miR) are 19-25 nucleotide noncoding RNAs that bind to the sites of nucleic acid targets and downregulate gene expression either by reducing nucleic acid molecule stability or by inhibiting translation. In some embodiments, a microRNA sequence comprises a seed region, e.g., a sequence in the region of positions 2-8 of the mature microRNA, which has Watson-Crick sequence fully or partially complementarity to the miRNA target sequence of the nucleic acid.

In one embodiment, the viral genome may be engineered to include, alter or remove at least one miRNA binding site, full sequence or seed region.

Any UTR from any gene known in the art may be incorporated into the viral genome of the AAV particle. These UTRs, or portions thereof, may be placed in the same orientation as in the gene from which they were selected or they may be altered in orientation or location. In one embodiment, the UTR used in the viral genome of the AAV particle may be inverted, shortened, lengthened, made with one or more other 5' UTRs or 3' UTRs known in the art. As used herein, the term "altered" as it relates to a UTR, means that the UTR has been changed in some way in relation to a reference sequence. For example, a 3' or 5' UTR may be altered relative to a wild type or native UTR by the change in orientation or location as taught above or may be altered by the inclusion of additional nucleotides, deletion of nucleotides, swapping or transposition of nucleotides.

In one embodiment, the viral genome of the AAV particle comprises at least one artificial UTR which is not a variant of a wild type UTR.

In one embodiment, the viral genome of the AAV particle comprises UTRs which have been selected from a family of transcripts whose proteins share a common function, structure, feature or property.

Viral Genome Component: Polyadenylation Sequence

The viral genome of the AAV particle described herein (e.g., an AAV particle comprising an AAV capsid variant, described herein) may comprise a polyadenylation sequence. In some embodiments, the viral genome of the AAV particle (e.g., an AAV particle comprising an AAV capsid variant, described herein) comprises a polyadenylation sequence between the 3' end of the nucleotide sequence encoding the payload and the 5' end of the 3'ITR.

Viral Genome Component: Introns

In some embodiments, the viral genome of the AAV particle as described herein (e.g., an AAV particle comprising an AAV capsid variant), comprises an element to enhance the payload target specificity and expression (See e.g., Powell et al. *Viral Expression Cassette Elements to Enhance Transgene Target Specificity and Expression in Gene Therapy*, Discov. Med, 2015, 19(102): 49-57; the contents of which are herein incorporated by reference in their entirety), such as an intron. Non-limiting examples of introns include, MVM (67-97 bps), F.IX truncated intron 1 (300 bps), (β-globin SD/immunoglobulin heavy chain splice acceptor (250 bps), adenovirus splice donor/immunoglobin splice acceptor (500 bps), SV40 late splice donor/splice acceptor (19S/16S) (180 bps) and hybrid adenovirus splice donor/IgG splice acceptor (230 bps).

Viral Genome Component: Stuffer Sequences

In some embodiments, the viral genome of an AAV particle described herein (e.g., an AAV particle comprising an AAV capsid polypeptide, e.g., an AAV capsid variant), comprises an element to improve packaging efficiency and expression, such as a stuffer or filler sequence. Non-limiting examples of stuffer sequences include albumin and/or alpha-1 antitrypsin. Any known viral, mammalian, or plant sequence may be manipulated for use as a stuffer sequence.

In one embodiment, the stuffer or filler sequence may be from about 100-3500 nucleotides in length. The stuffer sequence may have a length of about 100, 200, 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900 or 3000 nucleotides.

Viral Genome Component: miRNA

In one embodiment, the viral genome comprises a sequence encoding a miRNA to reduce the expression of the payload in a tissue or cell, e.g., the DRG (dorsal root ganglion), or neurons of other ganglia, such as those of the sympathetic or parasympathetic nervous system. In some embodiments, a miRNA, e.g., a miR183, a miR182, and/or miR96, may be encoded in the viral genome to modulate, e.g., reduce the expression, of the viral genome in a DRG neuron. As another non-limiting example, a miR-122 miRNA may be encoded in the viral genome to modulate, e.g., reduce, the expression of the viral genome in the liver. In some embodiments, a miRNA, e.g., a miR-142-3p, may be encoded in the viral genome to modulate, e.g., reduce, the expression, of the viral genome in a cell or tissue of the hematopoietic lineage, including for example immune cells (e.g., antigen presenting cells or APC, including dendritic cells (DCs), macrophages, and B-lymphocytes). In some embodiments, a miRNA, e.g., a miR-1, may be encoded in the viral genome to modulate, e.g., reduce, the expression, of the viral genome in a cell or tissue of the heart.

Viral Genome Component: miR Binding Site

Tissue- or cell-specific expression of the AAV viral particles disclosed herein can be enhanced by introducing tissue- or cell-specific regulatory sequences, e.g., promoters, enhancers, microRNA binding sites, e.g., a detargeting site. Without wishing to be bound by theory, it is believed that an encoded miR binding site can modulate, e.g., prevent, suppress, or otherwise inhibit, the expression of a gene of interest on the viral genome disclosed herein, based on the expression of the corresponding endogenous microRNA (miRNA) or a corresponding controlled exogenous miRNA in a tissue or cell, e.g., a non-targeting cell or tissue. In some embodiments, a miR binding site modulates, e.g., reduces, expression of the payload encoded by a viral genome of an AAV particle described herein in a cell or tissue where the corresponding mRNA is expressed.

In some embodiments, the viral genome of an AAV particle described herein comprises a nucleotide sequence encoding a microRNA binding site, e.g., a detargeting site. In some embodiments, the viral genome of an AAV particle described herein comprises a nucleotide sequence encoding a miR binding site, a microRNA binding site series (miR BSs), or a reverse complement thereof.

In some embodiments, the nucleotide sequence encoding the miR binding site series or the miR binding site is located in the 3'-UTR region of the viral genome (e.g., 3' relative to the nucleotide sequence encoding a payload), e.g., before the polyA sequence, 5'-UTR region of the viral genome (e.g., 5' relative to the nucleotide sequence encoding a payload), or both.

In some embodiments, the encoded miR binding site series comprise at least 1-5 copies, e.g., at least 1-3, 2-4, 3-5, 1, 2, 3, 4, 5 or more copies of a miR binding site (miR BS). In some embodiments, all copies are identical, e.g., comprise the same miR binding site. In some embodiments, the miR binding sites within the encoded miR binding site series are continuous and not separated by a spacer. In some embodiments, the miR binding sites within an encoded miR binding site series are separated by a spacer, e.g., a non-coding sequence. In some embodiments, the spacer is about 1 to 6 nucleotides or about 5 to 10 nucleotides, e.g., about 7-8 nucleotides, nucleotides in length. In some embodiments, the spacer coding sequence or reverse complement thereof comprises one or more of (i) GGAT; (ii) CACGTG; (iii) GCATGC, or a repeat of one or more of (i)-(iii). In some embodiments, the spacer comprises the nucleotide sequence of GATAGTTA, or a nucleotide sequence having at least one, two, or three modifications, e.g., substitutions (e.g., conservative substitutions), insertions, or deletions, but no more than four modifications, e.g., substitutions (e.g., conservative substitutions), insertions, or deletions relative to the nucleotide sequence of GATAGTTA.

In some embodiments, the encoded miR binding site series comprise at least 1-5 copies, e.g., at least 1-3, 2-4, 3-5, 1, 2, 3, 4, 5 or more copies of a miR binding site (miR BS). In some embodiments, at least 1, 2, 3, 4, 5, or all of the copies are different, e.g., comprise a different miR binding site. In some embodiments, the miR binding sites within the encoded miR binding site series are continuous and not separated by a spacer. In some embodiments, the miR binding sites within an encoded miR binding site series are separated by a spacer, e.g., a non-coding sequence. In some embodiments, the spacer is about 1 to 6 nucleotides or about 5 to 10 nucleotides, e.g., about 7-8 nucleotides, in length. In some embodiments, the spacer comprises one or more of (i) GGAT; (ii) CACGTG; (iii) GCATGC, or a repeat of one or more of (i)-(iii). In some embodiments, the spacer comprises the nucleotide sequence of GATAGTTA, or a nucleotide sequence having at least one, two, or three modifications, e.g., substitutions (e.g., conservative substitutions), insertions, but no more than four modifications, e.g., substitutions (e.g., conservative substitutions), insertions, or deletions relative to the nucleotide sequence of GATAGTTA.

In some embodiments, the encoded miR binding site is substantially identical (e.g., at least 70%, 75%, 80%, 85%, 90%, 95%, 99% or 100% identical), to the miR in the host cell. In some embodiments, the encoded miR binding site comprises at least 1, 2, 3, 4, or 5 mismatches or no more than 6, 7, 8, 9, or 10 mismatches to a miR in the host cell. In some embodiments, the mismatched nucleotides are contiguous. In some embodiments, the mismatched nucleotides are non-contiguous. In some embodiments, the mismatched nucleotides occur outside the seed region-binding sequence of the miR binding site, such as at one or both ends of the miR binding site. In some embodiments, the miR binding site is 100% identical to the miR in the host cell.

In some embodiments, the nucleotide sequence encoding the miR binding site is substantially complementary (e.g., at least 70%, 75%, 80%, 85%, 90%, 95%, 99% or 100% complementary), to the miR in the host cell. In some embodiments, to complementary sequence of the nucleotide sequence encoding the miR binding site comprises at least 1, 2, 3, 4, or 5 mismatches or no more than 6, 7, 8, 9, or 10 mismatches to a miR in the host cell. In some embodiments, the mismatched nucleotides are contiguous. In some embodiments, the mismatched nucleotides are non-contiguous. In some embodiments, the mismatched nucleotides occur outside the seed region-binding sequence of the miR binding site, such as at one or both ends of the miR binding site. In some embodiments, the encoded miR binding site is 100% complementary to the miR in the host cell.

In some embodiments, an encoded miR binding site or sequence region is at least about 10 to about 125 nucleotides in length, e.g., at least about 10 to 50 nucleotides, 10 to 100 nucleotides, 50 to 100 nucleotides, 50 to 125 nucleotides, or 100 to 125 nucleotides in length. In some embodiments, an encoded miR binding site or sequence region is at least about 7 to about 28 nucleotides in length, e.g., at least about 8-28 nucleotides, 7-28 nucleotides, 8-18 nucleotides, 12-28 nucleotides, 20-26 nucleotides, 22 nucleotides, 24 nucleotides, or 26 nucleotides in length, and optionally comprises at least one consecutive region (e.g., 7 or 8 nucleotides) complementary (e.g., fully or partially complementary) to the seed sequence of a miRNA (e.g., a miR122, a miR142, a miR183, or a miR1).

In some embodiments, the encoded miR binding site is complementary (e.g., fully or partially complementary) to a miR expressed in liver or hepatocytes, such as miR122. In some embodiments, the encoded miR binding site or encoded miR binding site series comprises a miR122 binding site sequence. In some embodiments, the encoded miR122 binding site comprises the nucleotide sequence of ACAAACACCATTGTCACACTCCA (SEQ ID NO: 4673), or a nucleotide sequence having at least 50%, 55%, 60%, 65%, 70%, 75%, 80%, 85%, 90%, at least 95%, at least 99%, or 100% sequence identity, or having at least one, two, three, four, five, six, or seven modifications, e.g., substitutions (e.g., conservative substitutions), insertions, or deletions, but no more than ten modifications, e.g., insertions, deletions, or substitutions (e.g., conservative substitutions), relative to the nucleotide sequence of SEQ ID NO: 4673, e.g., wherein the modification can result in a mismatch between the encoded miR binding site and the corresponding miRNA. In some embodiments, the viral genome comprises at least 2, 3, 4, or 5 copies of the encoded miR122 binding site, e.g., an encoded miR122 binding site series, optionally wherein the encoded miR122 binding site series comprises the nucleotide sequence of: ACAAACACCATTGT-CACACTCCACACAAACACCATTGTCACACTC-CACACAAACACCATTGTCACACT CCA (SEQ ID NO: 4674), or a nucleotide sequence having at least 50%, 55%, 60%, 65%, 70%, 75%, 80%, 85%, 90%, at least 95%, at least 99%, or 100% sequence identity, or having at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 4674, e.g., wherein the modification can result in a mismatch between the encoded miR binding site and the corresponding miRNA. In some embodiments, at least two of the encoded miR122 binding sites are connected directly, e.g., without a spacer. In other embodiments, at least two of the encoded miR122 binding sites are separated by a spacer, e.g., 1, 2, 3, 4, 5, 6, 7, 8, 9, or 10 nucleotides in length, which is located between two or more consecutive encoded miR122 binding site sequences. In embodiments, the spacer is about 1 to 6 nucleotides or about 5 to 10 nucleotides, e.g., about 7-8, in length. In some embodiments, the spacer coding sequence or reverse complement thereof comprises one or more of (i) GGAT; (ii) CACGTG; (iii) GCATGC, or a repeat of one or more of (i)-(iii). In some embodiments, an encoded miR binding site series comprises at least 3-5 copies (e.g., 4 copies) of a miR122 binding site, with or without a spacer, wherein the spacer is about 1 to 6 nucleotides or about 5 to 10 nucleotides, e.g., about 7-8 nucleotides or about 8 nucleotides, in length. In some embodiments, the spacer comprises the nucleotide sequence of GATAGTTA, or a nucleotide sequence having at least one, two, or three modifications, e.g., substitutions (e.g., conservative substitutions), insertions, or deletions, but no more than four modifications, e.g., substitutions (e.g., conservative substitutions), insertions, or deletions relative to the nucleotide sequence of GATAGTTA.

In some embodiments, the encoded miR binding site is complementary (e.g., fully or partially complementary) to a miR expressed in the heart. In embodiments, the encoded miR binding site or encoded miR binding site series comprises a miR-1 binding site. In some embodiments, the encoded miR-1 binding site comprises the nucleotide sequence of ATACATACTTCTTTACATTCCA (SEQ ID NO: 4679), a nucleotide sequence having at least 50%, 55%, 60%, 65%, 70%, 75%, 80%, 85%, 90%, at least 95%, at least 99%, or 100% sequence identity, or having at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 4679, e.g., wherein the modification can result in a mismatch between the encoded miR binding site and the corresponding miRNA. In some embodiments, the viral genome comprises at least 2, 3, 4, or 5 copies of the encoded miR-1 binding site, e.g., an encoded miR-1 binding site series. In some embodiments, the at least 2, 3, 4, or 5 copies (e.g., 2 or 3 copies) of the encoded miR-1 binding site are continuous (e.g., not separated by a spacer) or separated by a spacer. In some embodiments, the spacer is about 1 to 6 nucleotides or about 5 to 10 nucleotides, e.g., about 7-8 nucleotides or about 8 nucleotides, in length. In some embodiments, the spacer sequence comprises one or more of (i) GGAT; (ii) CACGTG; (iii) GCATGC, or a repeat of one or more of (i)-(iii). In some embodiments, the spacer comprises the nucleotide sequence of GATAGTTA, or a nucleotide sequence having at least one, two, or three modifications, e.g., substitutions (e.g., conservative substitutions), insertions, or deletions, but no more than four modifications, e.g., substitutions (e.g., conservative substitutions), insertions, or deletions, relative to the nucleotide sequence of GATAGTTA.

In some embodiments, the encoded miR binding site is complementary (e.g., fully or partially complementary) to a miR expressed in hematopoietic lineage, including immune cells (e.g., antigen presenting cells or APC, including dendritic cells (DCs), macrophages, and B-lymphocytes). In some embodiments, the encoded miR binding site complementary to a miR expressed in hematopoietic lineage comprises a nucleotide sequence disclosed, e.g., in US 2018/0066279, the contents of which are incorporated by reference herein in its entirety.

In embodiments, the encoded miR binding site or encoded miR binding site series comprises a miR-142-3p binding site sequence. In some embodiments, the encoded miR-142-3p binding site comprises the nucleotide sequence of TCCAT-AAAGTAGGAAACACTACA (SEQ ID NO: 4675), a nucleotide sequence having at least 50%, 55%, 60%, 65%, 70%, 75%, 80%, 85%, 90%, at least 95%, at least 99%, or 100% sequence identity, or having at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 4675, e.g., wherein the modification can result in a mismatch between the encoded miR binding site and the corresponding miRNA. In some embodiments, the viral genome comprises at least 2, 3, 4, or 5 copies of the encoded miR-142-3p binding site, e.g., an encoded miR-142-3p binding site series. In some embodiments, the at least 2, 3, 4, or 5 copies (e.g., 2 or 3 copies) of the encoded miR-142-3p binding site are continuous (e.g., not separated by a spacer) or separated by a spacer. In some embodiments, the spacer is about 1 to 6 nucleotides or about 5 to 10 nucleotides, e.g., about 7-8 nucleotides or about 8 nucleotides, in length. In some embodiments, the spacer sequence comprises one or more of (i) GGAT; (ii) CACGTG; (iii) GCATGC, or a repeat of one or more of (i)-(iii). In some embodiments, the spacer comprises the nucleotide sequence of GATAGTTA, or a nucleotide sequence having at least one, two, or three modifications, e.g., substitutions (e.g., conservative substitutions), insertions, or deletions, but no more than four modifications, e.g., substitutions (e.g., conservative substitutions), insertions, or deletions, relative to the nucleotide sequence of GATAGTTA.

In some embodiments, the encoded miR binding site is complementary (e.g., fully complementary or partially complementary) to a miR expressed in a DRG (dorsal root ganglion) neuron, e.g., a miR183, a miR182, and/or miR96 binding site. In some embodiments, the encoded miR binding site is complementary to a miR expressed in expressed in a DRG neuron comprises a nucleotide sequence disclosed, e.g., in WO2020/132455, the contents of which are incorporated by reference herein in its entirety.

In some embodiments, the encoded miR binding site or encoded miR binding site series comprises a miR183 binding site sequence. In some embodiments, the encoded miR183 binding site comprises the nucleotide sequence of AGTGAATTCTACCA<u>GTGCCATA</u> (SEQ ID NO: 4676), or a nucleotide sequence having at least 50%, 55%, 60%, 65%, 70%, 75%, 80%, 85%, 90%, at least 95%, at least 99%, or 100% sequence identity, or having at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 4676, e.g., wherein the modification can result in a mismatch between the encoded miR binding site and the corresponding miRNA. In some embodiments, the sequence complementary to the seed sequence corresponds to the double underlined of the encoded miR-183 binding site sequence. In some embodiments, the viral genome comprises at least comprises at least 2, 3, 4, or 5 copies (e.g., at least 2 or 3 copies) of the encoded miR183 binding site, e.g., an encoded miR183 binding site. In some embodiments, the at least 2, 3, 4, or 5 copies (e.g., 2 or 3 copies) of the encoded miR183 binding site are continuous (e.g., not separated by a spacer) or separated by a spacer. In some embodiments, the spacer is about 1 to 6 nucleotides or about 5 to 10 nucleotides, e.g., about 7-8 nucleotides or about 8 nucleotides, in length. In some embodiments, the spacer comprises the nucleotide sequence of GATAGTTA, or a nucleotide sequence having at least one, two, or three modifications, e.g., substitutions (e.g., conservative substitutions), insertions, or deletions, but no more than four modifications, e.g., substitutions (e.g., conservative substitutions), insertions, or deletions, relative to the nucleotide sequence of GATAGTTA. In some embodiments, the spacer sequence comprises one or more of (i) GGAT; (ii) CACGTG; (iii) GCATGC, or a repeat of one or more of (i)-(iii).

In some embodiments, the encoded miR binding site or the encoded miR binding site series comprises a miR182 binding site sequence. In some embodiments, the encoded miR182 binding site comprises, the nucleotide sequence of AGTGTGAGTTCTACCATTGCCAAA (SEQ ID NO: 4677), a sequence having at least 50%, 55%, 60%, 65%, 70%, 75%, 80%, 85%, 90%, at least 95%, at least 99%, or 100% sequence identity, or having at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 4677, e.g., wherein the modification can result in a mismatch between the encoded miR binding site and the corresponding miRNA. In some embodiments, the viral genome comprises at least 2, 3, 4, or 5 copies of the encoded miR182 binding site, e.g., an encoded miR182 binding site series. In some embodiments, the at least 2, 3, 4, or 5 copies (e.g., 2 or 3 copies) of the encoded miR182 binding site are continuous (e.g., not separated by a spacer) or separated by a spacer. In some embodiments, the spacer is about 1 to 6 nucleotides or about 5 to 10 nucleotides, e.g., about 7-8 nucleotides or about 8 nucleotides, in length. In some embodiments, the spacer comprises the nucleotide sequence of GATAGTTA, or a nucleotide sequence having at least one, two, or three modifications, e.g., substitutions (e.g., conservative substitutions), insertions, or deletions, but no more than four modifications, e.g., substitutions (e.g., conservative substitutions), insertions, or deletions, relative to the nucleotide sequence of GATAGTTA. In some embodiments, the spacer sequence comprises one or more of (i) GGAT; (ii) CACGTG; (iii) GCATGC, or a repeat of one or more of (i)-(iii).

In certain embodiments, the encoded miR binding site or the encoded miR binding site series comprises a miR96 binding site sequence. In some embodiments, the encoded miR96 binding site comprises the nucleotide sequence of AGCAAAAATGTGCTAGTGCCAAA (SEQ ID NO: 4678), a sequence having at least 50%, 55%, 60%, 65%, 70%, 75%, 80%, 85%, 90%, at least 95%, at least 99%, or 100% sequence identity, or having at least one, two, three, four, five, six, or seven modifications, e.g., substitutions (e.g., conservative substitutions), insertions, or deletions, but no more than ten modifications, e.g., substitutions (e.g., conservative substitutions), insertions, or deletions, relative to the nucleotide sequence of SEQ ID NO: 4678, e.g., wherein the modification can result in a mismatch between the encoded miR binding site and the corresponding miRNA. In some embodiments, the viral genome comprises at least 2, 3, 4, or 5 copies of the encoded miR96 binding site, e.g., an encoded miR96 binding site series. In some embodiments, the at least 2, 3, 4, or 5 copies (e.g., 2 or 3 copies) of the encoded miR96 binding site are continuous (e.g., not separated by a spacer) or separated by a spacer. In some embodiments, the spacer is about 1 to 6 nucleotides or about 5 to 10 nucleotides, e.g., about 7-8 nucleotides or about 8 nucleotides, in length. In some embodiments, the spacer comprises the nucleotide sequence of GATAGTTA, or a nucleotide sequence having at least one, two, or three modifications, e.g., substitutions (e.g., conservative substitutions), insertions, or deletions, but no more than four modifications, e.g., substitutions (e.g., conservative substitutions), insertions, or deletions, relative to the nucleotide sequence of GATAGTTA. In some embodiments, the spacer sequence comprises one or more of (i) GGAT; (ii) CACGTG; (iii) GCATGC, or a repeat of one or more of (i)-(iii).

In some embodiments, the encoded miR binding site series comprises a miR122 binding site, a miR-1, a miR142 binding site, a miR183 binding site, a miR182 binding site, a miR 96 binding site, or a combination thereof. In some embodiments, the encoded miR binding site series comprises at least 2, 3, 4, or 5 copies of a miR122 binding site, a miR142 binding site, a miR183 binding site, a miR182 binding site, a miR 96 binding site, or a combination thereof. In some embodiments, at least two of the encoded miR binding sites are connected directly, e.g., without a spacer. In other embodiments, at least two of the encoded miR binding sites are separated by a spacer, e.g., 1, 2, 3, 4, 5, 6, 7, 8, 9, or 10 nucleotides in length, which is located between two or more consecutive encoded miR binding site sequences. In embodiments, the spacer is at least about 5 to 10 nucleotides, e.g., about 7-8 nucleotides or about 8 nucleotides, in length. In some embodiments, the spacer coding sequence or reverse complement thereof comprises one or more of (i) GGAT; (ii) CACGTG; (iii) GCATGC, or a repeat of one or more of (i)-(iii). In some embodiments, the spacer comprises the nucleotide sequence of GATAGTTA, or a nucleotide sequence having at least one, two, or three modifications, e.g., substitutions (e.g., conservative substitutions), insertions, or deletions, but no more than four modifications, e.g., substitutions (e.g., conservative substitutions), insertions, or deletions, relative to the nucleotide sequence of GATAGTTA.

In some embodiments, an encoded miR binding site series comprises at least 2-5 copies (e.g., 2 or 3 copies) of a combination of at least two, three, four, five, or all of a miR-1, miR122 binding site, a miR142 binding site, a miR183 binding site, a miR182 binding site, a miR96 binding site, wherein each of the miR binding sites within the series are continuous (e.g., not separated by a spacer) or are separated by a spacer. In some embodiments, the spacer is about 1 to 6 nucleotides or about 5 to 10 nucleotides, e.g., about 7-8 nucleotides or about 8 nucleotides, in length. In some embodiments, the spacer sequence comprises one or more of (i) GGAT; (ii) CACGTG; (iii) GCATGC, or a repeat of one or more of (i)-(iii). In some embodiments, the spacer comprises the nucleotide sequence of GATAGTTA, or a nucleotide sequence having at least one, two, or three modifications, e.g., substitutions (e.g., conservative substitutions), insertions, or deletions, but no more than four modifications, e.g., substitutions (e.g., conservative substitutions), insertions, or deletions, relative to the nucleotide sequence of GATAGTTA.

In some embodiments, an encoded miR binding site series comprises at least 2-5 copies (e.g., 2 or 3 copies) of a combination of a miR-122 binding site and a miR-1 binding site, wherein each of the miR binding sites within the series are continuous (e.g., not separated by a spacer) or are separated by a spacer. In some embodiments, the spacer is about 1 to 6 nucleotides or about 5 to 10 nucleotides, e.g., about 7-8 nucleotides or about 8 nucleotides, in length. In some embodiments, the spacer sequence comprises one or more of (i) GGAT; (ii) CACGTG; (iii) GCATGC, or a repeat of one or more of (i)-(iii). In some embodiments, the spacer comprises the nucleotide sequence of GATAGTTA, or a nucleotide sequence having at least one, two, or three modifications, e.g., substitutions (e.g., conservative substitutions), insertions, or deletions, but no more than four modifications, e.g., substitutions (e.g., conservative substitutions), insertions, or deletions, relative to the nucleotide sequence of GATAGTTA.

Genome Size

In one embodiment, the AAV particle described herein (e.g., an AAV particle comprising an AAV capsid variant), may comprise a single-stranded or double-stranded viral genome. The size of the viral genome may be small, medium, large or the maximum size. As described above, the viral genome may comprise a promoter and a polyA tail.

In one embodiment, the viral genome may be a small single stranded viral genome. A small single stranded viral genome may be 2.1 to 3.5 kb in size such as, but not limited to, about 2.1, 2.2, 2.3, 2.4, 2.5, 2.6, 2.7, 2.8, 2.9, 3.0, 3.1, 3.2, 3.3, 3.4, and 3.5 kb in size.

In one embodiment, the viral genome may be a small double stranded viral genome. A small double stranded viral genome may be 1.3 to 1.7 kb in size such as, but not limited to, about 1.3, 1.4, 1.5, 1.6, and 1.7 kb in size.

In one embodiment, the viral genome may be a medium single stranded viral genome. A medium single stranded viral genome may be 3.6 to 4.3 kb in size such as, but not limited to, about 3.6, 3.7, 3.8, 3.9, 4.0, 4.1, 4.2 and 4.3 kb in size.

In one embodiment, the viral genome may be a medium double stranded viral genome. A medium double stranded viral genome may be 1.8 to 2.1 kb in size such as, but not limited to, about 1.8, 1.9, 2.0, and 2.1 kb in size.

In one embodiment, the viral genome may be a large single stranded viral genome. A large single stranded viral genome may be 4.4 to 6.0 kb in size such as, but not limited to, about 4.4, 4.5, 4.6, 4.7, 4.8, 4.9, 5.0, 5.1, 5.2, 5.3, 5.4, 5.5, 5.6, 5.7, 5.8, 5.9 and 6.0 kb in size.

In one embodiment, the viral genome may be a large double stranded viral genome. A large double stranded viral genome may be 2.2 to 3.0 kb in size such as, but not limited to, about 2.2, 2.3, 2.4, 2.5, 2.6, 2.7, 2.8, 2.9 and 3.0 kb in size.

Payloads

In some embodiments, an AAV particle of the present disclosure (e.g. an AAV particle comprising an AAV capsid variant described herein) comprises a viral genome comprising a nucleic acid encoding a payload. In some embodiments, the encoded payload is an RNAi agent or a polypeptide. A payload of the present disclosure may be, but is not limited to, a peptide, a polypeptide, a protein, an antibody, an RNAi agent, etc.

In some embodiments, the nucleotide sequence encoding a payload may comprise a combination of coding and non-coding nucleic acid sequences. In some embodiments, the nucleotide sequence encoding the payload may encode a coding or non-coding RNA.

In some embodiments, the AAV particles described herein, e.g., an AAV particle comprising an AAV capsid variant, comprises a nucleic acid encoding a payload. In some embodiments, the encoded payload comprises a therapeutic protein, an antibody, an enzyme, one or more components of a genome editing system, and/or an RNAi agent (e.g., a dsRNA, siRNA, shRNA, pre-miRNA, pri-miRNA, miRNA, stRNA, lncRNA, piRNA, or snoRNA). In some embodiments, the encoded payload modulates, e.g., increases or decreases, the presence, level, and/or activity of a gene, mRNA, protein, or a combination thereof, e.g., in a cell or a tissue.

Polypeptides

In some embodiments, the encoded payload of AAV particle comprising an AAV capsid polypeptide, e.g., an AAV capsid variant, described herein comprises a polypeptide, protein, or peptide, e.g., a polypeptide, protein, or peptide described herein. The nucleic acid encoding the payload, may encode a product of any known gene and/or a recombinant version thereof. In some embodiments, the nucleic acid encoding the payload may encode at least one allele of apolipoprotein E (APOE) such as, but not limited to ApoE2, ApoE3 and/or ApoE4. In one embodiment, the nucleic acid encoding the payload encodes ApoE2 (cys112, cys158) protein or a fragment or variant thereof. In one embodiment, the nucleic acid encoding the payload encodes an ApoE3 (cys112, arg158) protein or fragment or variant thereof. In one embodiment, the nucleic acid encoding the payload encodes ApoE4 (arg112, arg158). As another non-limiting example, the encoded payload comprises an aromatic L-amin acid decarboxylase (AADC) protein. As another non-limiting example, the encoded payload comprises an antibody, or a fragment thereof. As another non-limiting example, the encoded payload comprises a human survival of motor neuron (SMN) 1 or SMN2 protein, or fragments or variants thereof. As another non-limiting example, the encoded payload region comprises a glucocerebrosidase (GBA1) protein, or a fragment or variant thereof. As another non-limiting example, the encoded payload comprises a granulin precursor or progranulin (GRN) protein, or a fragment or variant thereof. As another non-limiting example, the encoded payload comprises an aspartoacylase (ASPA) protein, or a fragment or variant thereof. As another non-limiting example, the encoded payload comprises a tripeptidyl peptidase I (CLN2) protein, or a fragment or variant thereof. As another non-limiting example, the encoded payload comprises a beta-galactosidase (GLB1) protein, or a fragment or variant thereof. As another non-limiting example, the encoded payload comprises a N-sulphoglucosamine sulphohydrolase (SGSH) protein, or a fragment or variant thereof. As another non-limiting example, the encoded payload comprises an N-acetyl-alpha-glucosaminidase (NAGLU) protein, or a fragment or variant thereof. As another non-limiting example, the encoded payload comprises a iduronate 2-sulfatase (IDS) protein, or a fragment or variant thereof. As another non-limiting example, the encoded payload comprises an intracellular cholesterol transporter (NPC1) protein, or a fragment or variant thereof. As another non-limiting example, the encoded payload comprises a gigaxonin (GAN) protein, or a fragment or variant thereof. The AAV viral genomes encoding polypeptides described herein may be useful in the fields of human disease, viruses, infections veterinary applications and a variety of in vivo and in vitro settings.

Amino acid sequences of a payload polypeptide encoded by a viral genome described herein, may be translated as a whole polypeptide, a plurality of polypeptides or fragments of polypeptides, which independently may be encoded by one or more nucleic acids, fragments of nucleic acids or variants of any of the aforementioned.

Antibodies and Antibody Binding Fragments

In some embodiments, the encoded payload of AAV particle comprising an AAV capsid variant described herein comprises an antibody or antibody binding fragment. In some embodiments, the antibody may be a full antibody, a fragment, or any functional variant thereof. As non-limiting examples, an antibody may be a native antibody (e.g., with two heavy and two light chains), a heavy chain variable region, a light chain variable region, a heavy chain constant region, a light chain constant region, Fab, Fab', F(ab')$_2$, Fv, or scFv fragments, a diabody, a linear antibody, a single-chain antibody, a multi-specific antibody, an intrabody, one or more heavy chain complementarity determining regions (CDR), one or more light chain CDRs, a bi-specific antibody, a monoclonal antibody, a polyclonal antibody, a humanized antibody, an antibody mimetic, an antibody variant, a miniaturized antibody, a unibody, a maxibody, and/or a chimeric antigen receptor. The encoded antibody or antibody binding fragment may be useful in the treatment of a neurological disease, a neurodegenerative disorder, a muscular disease, a neuromuscular disorder, a neuro-oncological disorder, or any disorder associated with the central and/or peripheral nervous systems.

In some embodiments, the viral genome of the AAV particle (e.g., an AAV particle comprising an AAV capsid variant described herein) may comprise a nucleic acid which has been engineered to enable or enhance the expression of an antibody, or antibody binding fragment thereof.

In some embodiments, the encoded antibody of the payload of an AAV particle comprising an AAV capsid variant, described herein comprises at least one immunoglobulin variable domain sequence. An antibody may include, for example, full-length, mature antibodies and antigen-binding fragments of an antibody. For example, an antibody can include a heavy (H) chain variable domain sequence (VH), and a light (L) chain variable domain sequence (VL). In another example, an antibody includes two heavy (H) chain variable domain sequences and two light (L) chain variable domain sequence, thereby forming two antigen binding sites, such as Fab, Fab', F(ab')2, Fc, Fd, Fd', Fv, single chain antibodies (scFv for example), single variable domain antibodies, diabodies (Dab) (bivalent and bispecific), and chimeric (e.g., humanized) antibodies, which may be produced by the modification of whole antibodies or those synthesized de novo using recombinant DNA technologies. These functional antibody fragments, e.g., an antibody binding fragments, retain the ability to selectively bind with their respective antigen or receptor.

In some embodiments, the antibody binding fragment comprises at least one portion of an intact antibody, or recombinant variants thereof, and refers to the antigen binding domain, for example, an antigenic determining variable region of an intact antibody, that is sufficient to confer recognition and specific binding of the antibody fragment to a target, such as an antigen. Examples of antigen binding fragments include: (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a diabody (dAb) fragment, which consists of a VH domain; (vi) a camelid or camelized variable domain; (vii) a single chain Fv (scFv), see e.g., Bird et al. (1988) Science 242:423-426; and Huston et al. (1988) Proc. Natl. Acad. Sci. USA 85:5879-5883); and (viii) a single domain antibody. These antibody fragments are obtained using conventional techniques known to those with skill in the art, and the fragments are screened for utility in the same manner as are intact antibodies. An antibody fragment can also be incorporated into single domain antibodies, maxibodies, minibodies, nanobodies, intrabodies, diabodies, triabodies, tetrabodies, v-NAR and bis-scFv (see, for example, Hollinger and Hudson, Nature Biotechnology 23:1126-1136, 2005).

In some embodiments, the encoded antibody of the payload of an AAV particle described herein comprises a multispecific antibody, e.g., it comprises a plurality of immunoglobulin variable domains sequences, wherein a first immunoglobulin variable domain sequence of the plurality has binding specificity for a first epitope and a second immunoglobulin variable domain sequence of the plurality has binding specificity for a second epitope. In some embodiments, the first and second epitopes are on the same antigen, e.g., the same protein (or subunit of a multimeric protein). In some embodiments, the first and second epitopes overlap. In some embodiments, the first and second epitopes do not overlap. In some embodiments, the first and second epitopes are on different antigens, e.g., the different proteins (or different subunits of a multimeric protein). In some embodiments, a multispecific antibody comprises a third, fourth or fifth immunoglobulin variable domain. In some embodiments, a multispecific antibody is a bispecific antibody, a trispecific antibody, or tetraspecific antibody.

In some embodiments, an encoded multispecific antibody of the payload of an AAV particle described herein is an encoded bispecific antibody. A bispecific antibody has specificity for no more than two antigens. A bispecific antibody is characterized by a first immunoglobulin variable domain sequence which has binding specificity for a first epitope and a second immunoglobulin variable domain sequence that has binding specificity for a second epitope. In some embodiments, the first and second epitopes are on the same antigen, e.g., the same protein (or subunit of a multimeric protein). In some embodiments, the first and second epitopes overlap. In some embodiments, the first and second epitopes do not overlap. In some embodiments, the first and second epitopes are on different antigens, e.g., the different proteins (or different subunits of a multimeric protein).

An antibody or an antibody binding fragment encoded by a viral genome of an AAV particle described herein, may be, but is not limited to, an antibody or antibody fragment that binds to β-amyloid, APOE, tau, SOD1, TDP-43, huntingtin, and/or synuclein. In some embodiments, the encoded payload comprises an antibody or antibody fragment that binds to a neuro-oncology related target, e.g., HER2, EGFR (e.g., EGFRvIII). In some embodiments, the encoded payload comprises an antibody that binds to HER2/neu. In some embodiments, the encoded payload comprises an antibody that binds to β-amyloid. In some embodiments, the encoded payload comprises an antibody that binds to tau.

Gene Editing System

In some embodiments, the encoded payload of AAV particle comprising an AAV capsid variant described herein comprises a gene editing system or one or more components thereof. In some embodiments, the gene editing system comprises nucleic acid sequences that encode proteins having enzymatic activity to (i) selectively induce double or single stranded breaks in a DNA or RNA sequence, or (ii) substitute, insert or delete a particular base or set of bases of a DNA or RNA sequence in the absence of a double or single stranded break in the DNA or RNA. In some embodiments, the gene editing system includes, but is not limited to a CRISPR-Cas system (including different Cas or Cas-related nucleases), a Zinc finger nuclease, a meganuclease, a TALEN or a base editors. In some embodiments, the gene editing system comprises a chromosomal integration of a transgene, e.g., introduced by a parvovirus vector in the absence of an exogenous nuclease or an enzymatic entity.

RNAi Agents

In some embodiments, the encoded payload of AAV particle comprising an AAV capsid variant described herein comprises an RNAi agent, e.g., an RNAi agent described herein. In some embodiments, the encoded payload of a viral genome of an AAV particle comprising an AAV capsid variant described herein comprises a dsRNA, a siRNA, a shRNA, a pre-miRNA, a pri-miRNA, a miRNA, a stRNA, a lncRNA, a piRNA, or a snoRNA. In some embodiments, the encoded payload comprises an RNAi agent for inhibiting expression of a SOD1, MAPT, APOE, HTT, C9ORF72, TDP-43, APP, BACE, SNCA, ATXN1, ATXN3, ATXN7, SCN1A-SCN5A, or SCN8A-SCN11A gene, protein, and/or mRNA. In some embodiments, the RNAi agent encoded by a viral genome described herein inhibits SOD1, MAPT, APOE, HTT, C9ORF72, TDP-43, APP, BACE, SNCA, ATXN1, ATXN3, ATXN7, SCN1A-SCN5A, or SCN8A-SCN11A.

An AAV particle comprising an AAV capsid variant described herein may comprise a viral genome encoding an RNAi agent, which targets the mRNA of a gene to modulate, e.g., interfere with gene expression and/or protein production.

In some embodiments, the RNAi agent may target a gene at the location of a single-nucleotide polymorphism (SNP) or variant within the nucleotide sequence of the gene.

The RNAi agent may be an siRNA duplex, wherein the siRNA duplex contains an antisense strand (guide strand) and a sense strand (passenger strand) hybridized together forming a duplex structure, wherein the antisense strand is complementary to the nucleic acid sequence of the targeted gene, and wherein the sense strand is homologous to the nucleic acid sequence of the targeted gene. In some aspects, the 5' end of the antisense strand has a 5' phosphate group and the 3' end of the sense strand contains a 3' hydroxyl group. In other aspects, there are none, one or 2 nucleotide overhangs at the 3' end of each strand.

Each strand of an siRNA duplex targeting a gene of interest may be about 19 to 25, 19 to 24 or 19 to 21 nucleotides in length, preferably about 19 nucleotides, 20 nucleotides, 21 nucleotides, 22 nucleotides, 23 nucleotides, 24 nucleotides, or 25 nucleotides in length.

In one embodiment, an siRNA or dsRNA includes at least two sequences that are complementary to each other. The dsRNA includes a sense strand having a first sequence and an antisense strand having a second sequence. The antisense strand includes a nucleotide sequence that is substantially complementary to at least part of an mRNA encoding the target gene, and the region of complementarity is 30 nucleotides or less, and at least 15 nucleotides in length. Generally, the dsRNA is 19 to 25, 19 to 24 or 19 to 21 nucleotides in length. In some embodiments, the dsRNA is from about 15 to about 25 nucleotides in length, and in other embodiments the dsRNA is from about 25 to about 30 nucleotides in length. In some embodiments, the dsRNA is about 15 nucleotides in length, 16 nucleotides in length, 17 nucleotides in length, 18 nucleotides in length, 19 nucleotides, 20 nucleotides, 21 nucleotides, 22 nucleotides, 23 nucleotides, 24 nucleotides, 25 nucleotides in length, 26 nucleotides in length, 27 nucleotides in length, 28 nucleotides in length, 29 nucleotides in length, or 30 nucleotides in length.

In some embodiments, the encoded RNAi agent is an siRNA.

In some embodiments, the RNAi agent, e.g., an RNAi agent described herein inhibits the expression of the gene, mRNA, and/or protein by at least 10%, at least 20%, at least 25%, at least 30%, at least 35% or at least 40% or more, such as when assayed by a method known in the art. In some embodiments, the RNAi agent inhibits expression of a gene, mRNA, and protein by 50-100%, e.g., by 30%, 40%, 50%, 60%, 70%, 80%, 85%, 90%, 95% and 100%.

In some embodiments, the AAV particle described herein, comprising a viral genome encoding an RNAi agent targeting a gene of interest is administered to a subject in need for treating and/or ameliorating a disease, e.g., a neurological disorder of any disease associated with the central or peripheral nervous systems.

Design of siRNA

An AAV particle described herein (e.g., an AAV particle comprising an AAV capsid variant described herein) may comprise a viral genome encoding a siRNA molecule (e.g., siRNA duplex or encoded dsRNA) that target a gene of interest and suppress target gene expression, mRNA expression, and protein production. In some aspects, the siRNA molecules are designed and used to knock out target gene variants in cells, e.g., transcripts that are identified in neurological disease. In some aspects, the siRNA molecules are designed and used to knock down target gene variants in cells.

Some guidelines for designing siRNAs (for insertion into a viral genome of the AAV particles described herein) have been proposed in the art. These guidelines generally recommend generating a 19-nucleotide duplexed region, symmetric 2-3 nucleotide 3' overhangs, 5-phosphate and 3-hydroxyl groups targeting a region in the gene to be silenced. Other rules that may govern siRNA sequence preference include, but are not limited to, (i) A/U at the 5' end of the antisense strand; (ii) G/C at the 5' end of the sense strand; (iii) at least five A/U residues in the 5' terminal one-third of the antisense strand; and (iv) the absence of any GC stretch of more than 9 nucleotides in length. In accordance with such considerations, together with the specific sequence of a target gene, highly effective siRNA molecules essential for suppressing mammalian target gene expression may be readily designed.

In one embodiment, the sense and/or antisense strand is designed based on the method and rules outlined in European Patent Publication No. EP1752536, the contents of which are herein incorporated by reference in their entirety. As a non-limiting example, the 3'-terminal base of the sequence is adenine, thymine or uracil. As a non-limiting example, the 5'-terminal base of the sequence is guanine or cytosine. As a non-limiting example, the 3'-terminal sequence comprises seven bases rich in one or more bases of adenine, thymine and uracil.

In one embodiment, an siRNA molecule comprises a sense strand and a complementary antisense strand in which both strands are hybridized together to form a duplex structure. The antisense strand has sufficient complementarity to the target mRNA sequence to direct target-specific RNAi, e.g., the siRNA molecule has a sequence sufficient to trigger the destruction of the target mRNA by the RNAi machinery or process.

In some embodiments, the antisense strand and target mRNA sequences have 100% complementarity. The antisense strand may be complementary to any part of the target mRNA sequence. Neither the identity of the sense sequence nor the homology of the antisense sequence need be 100% complementary to the target.

In other embodiments, the antisense strand and target mRNA sequences comprise at least one mismatch. As a non-limiting example, the antisense strand and the target mRNA sequence have at least 50-90%, 50-95%, 50-99%, 60-70%, 60-80%, 60-90%, 60-95%, 60-99%, 70-80%, 70-90%, 70-95%, 70-99%, 80-90%, 80-95%, 80-99%, 90-95%, 90-99% or 95-99% complementary.

The siRNA molecule may have a length from about 10-50 or more nucleotides, e.g., each strand comprising 10-50 nucleotides (or nucleotide analogs). Preferably, the siRNA molecule has a length from about 15-30, e.g., 15, 16, 17, 18, 19, 20, 21, 22, 23, 24, 25, 26, 27, 28, 29, or 30 nucleotides in each strand, wherein one of the strands is sufficiently complementary to a target region. In one embodiment, the siRNA molecule has a length from about 19 to 25, 19 to 24 or 19 to 21 nucleotides.

In some embodiments, the siRNA molecule can be a synthetic RNA duplex comprising about 19 nucleotides to about 25 nucleotides, and two overhanging nucleotides at the 3-end.

The siRNA molecule may comprise an antisense sequence and a sense sequence, or a fragment or variant thereof. As a non-limiting example, the antisense sequence and the sense sequence have at least 50-90%, 50-95%, 50-99%, 60-70%, 60-80%, 60-90%, 60-95%, 60-99%, 70-80%, 70-90%, 70-95%, 70-99%, 80-90%, 80-95%, 80-99%, 90-95%, 90-99% or 95-99% complementary.

The sense and antisense sequences may be completely complementary across a substantial portion of their length. In other embodiments, the sense sequence and antisense sequence may be at least 70, 80, 90, 95 or 99% complementary across independently at least 50, 60, 70, 80, 85, 90, 95, or 99% of the length of the strands.

In some embodiments, the sense and antisense strands of a siRNA duplex are linked by a short spacer sequence leading to the expression of a stem-loop structure termed short hairpin RNA (shRNA). The hairpin is recognized and cleaved by Dicer, thus generating mature siRNA molecules.

In some embodiments, the siRNA molecules, as well as associated spacer and/or flanking regions once designed, can be encoded by the viral genome of the AAV particles described herein, for delivery to a cell.

Molecular Scaffold

In some embodiments, the siRNA molecules may be encoded in a modulatory polynucleotide which also comprises a molecular scaffold.

In some embodiments, the modulatory polynucleotide which comprises the payload (e.g., siRNA, miRNA or other RNAi agent described herein) includes a molecular scaffold which comprises a 5' flanking sequence, a loop region, and/or a 3' flanking region. In some embodiments a 5' or 3' flanking region may be of any length and may a wild type microRNA sequence or a portion thereof, or may be completely artificial. A 3' flanking sequence may mirror the 5' flanking sequence in size and origin. Either flanking sequence may be absent. In one embodiment, both the 5' and 3' flanking sequences are absent. The 3' flanking sequence may optionally contain one or more CNNC motifs, where "N" represents any nucleotide. In some embodiments, the loop comprises at least one UGUG motif. In some embodiments, the UGUG motif is located at the 5' terminus of the loop. In some embodiments the 5' and 3' flanking sequences are the same sequence. In some embodiments they differ by 2%, 3%, 4%, 5%, 10%, 20% or more than 30% when aligned to each other.

In some embodiments, modulatory polynucleotide comprises a stem loop structure. In some embodiments, the modulatory polynucleotide comprises in 5' to 3' order: a 5' flanking sequence, a guide strand sequence, a loop region, a passenger strand sequence, and a 3' flanking sequence. In some embodiments, the modulatory polynucleotide comprises in 5' to 3' order: a 5' flanking sequence, a passenger strand sequence, a loop region, a guide strand sequence, and a 3' flanking sequence.

In one embodiment, the molecular scaffold comprises a dual-function targeting modulatory polynucleotide.

In one embodiment, the molecular scaffold may comprise one or more linkers known in the art. The linkers may separate regions or one molecular scaffold from another. As a non-limiting example, the molecular scaffold may be polycistronic.

In one embodiment, the modulatory polynucleotide is designed using at least one of the following properties: loop variant, seed mismatch/bulge/wobble variant, stem mismatch, loop variant and basal stem mismatch variant, seed mismatch and basal stem mismatch variant, stem mismatch and basal stem mismatch variant, seed wobble and basal stem wobble variant, or a stem sequence variant.

AAV Production

Viral production disclosed herein describes processes and methods for producing AAV particles (with enhanced, improved and/or increased tropism for a target tissue), e.g., an AAV particle comprising an AAV capsid variant that may be used to contact a target cell to deliver a payload.

In some embodiments, disclosed herein is a method of making AAV particle of the present disclosure, e.g., an AAV particle comprising an AAV capsid variant the method comprising: (i) providing a host cell comprising a viral genome described herein and (ii) incubating the host cell under conditions suitable to enclose the viral genome in an AAV capsid variant, e.g., an AAV capsid variant described herein (e.g., an AAV capsid variant listed in Tables 3, 4, or 5), thereby making the AAV particle. In some embodiments, the method comprises prior to step (i), introducing a first nucleic acid comprising the viral genome into a cell. In some embodiments, the host cell comprises a second nucleic acid encoding the AAV capsid variant. In some embodiments, the second nucleic acid is introduced into the host cell prior to, concurrently with, or after the first nucleic acid molecule. In some embodiments, the AAV particle described herein is an isolated AAV particle. In some embodiments, the AAV particle described herein is a recombinant AAV particle.

Any method known in the art may be used for the preparation of AAV particles. In some embodiments, AAV particles are produced in mammalian cells (e.g., HEK293). In another embodiment, AAV particles are produced in insect cells (e.g., Sf9).

Methods of making AAV particles are well known in the art and are described in e.g., U.S. Pat. Nos. 6,204,059, 5,756,283, 6,258,595, 6,261,551, 6,270,996, 6,281,010, 6,365,394, 6,475,769, 6,482,634, 6,485,966, 6,943,019, 6,953,690, 7,022,519, 7,238,526, 7,291,498 and 7,491,508, 5,064,764, 6,194,191, 6,566,118, 8,137,948; or International Publication Nos. WO1996039530, WO1998010088, WO1999014354, WO1999015685, WO1999047691, WO2000055342, WO2000075353 and WO2001023597; Methods In Molecular Biology, ed. Richard, Humana Press, NJ (1995); O'Reilly et al., Baculovirus Expression Vectors, A Laboratory Manual, Oxford Univ. Press (1994); Samulski et al., *J. Vir.* 63:3822-8 (1989); Kajigaya et al., *Proc. Nat'l. Acad. Sci.* USA 88: 4646-50 (1991); Ruffing et al., *J. Vir.* 66:6922-30 (1992); Kimbauer et al., *Vir.*, 219:37-44 (1996); Zhao et al., *J. Vir.* 272:382-93 (2000); the contents of each of which are herein incorporated by reference in their entirety. In some embodiments, the AAV particles are made using the methods described in International Patent Publication WO2015191508, the contents of which are herein incorporated by reference in their entirety.

Therapeutic Applications

The present disclosure provides a method for treating a disease, disorder and/or condition in a subject, including a human subject, comprising administering to the subject an AAV particle described herein, e.g., an AAV particle comprising an AAV capsid variant (e.g., an AAV capsid variant described herein), or administering to the subject any of the described compositions, including a pharmaceutical composition, described herein.

In some embodiments, the AAV particle (e.g., an AAV particle comprising an AAV capsid variant) is administered to a subject prophylactically, to prevent on-set of disease. In another embodiment, the AAV particle (e.g., an AAV particle comprising an AAV capsid variant) is administered to treat (e.g., lessen the effects of) a disease or symptoms thereof. In yet another embodiment, the AAV particle (e.g., an AAV particle comprising an AAV capsid variant) is administered to cure (eliminate) a disease. In another embodiment, the AAV particle (e.g., an AAV particle comprising an AAV capsid variant) of the present disclosure is administered to prevent or slow progression of disease. In yet another embodiment, the AAV particle (e.g., an AAV particle comprising an AAV capsid variant) of the present disclosure are used to reverse the deleterious effects of a disease. Disease status and/or progression may be determined or monitored by standard methods known in the art.

In some embodiments, the AAV particle of the disclosure (e.g., an AAV particle comprising an AAV capsid variant) is useful for treatment, prophylaxis, palliation or amelioration of a genetic disorder, e.g., an autosomal dominant genetic disorder, an autosomal recessive disorder, X-linked dominant genetic disorder, an X-linked recessive genetic disorder, or a Y-linked genetic disorder. In some embodiments, the genetic disorder is a monogenetic disorder or a polygenic disorder. In some embodiments, treatment of a genetic disorder, e.g., a monogenic disorder, comprises the use of an AAV particle described herein (e.g., an AAV particle comprising an AAV capsid variant described herein) for a gene replacement therapy.

In some embodiments, provided herein is method for treating a neurological disorder and/or neurodegenerative disorder in a subject, comprising administering to the subject an effective amount of a pharmaceutical composition described herein or an AAV particle, e.g., a plurality of particles, comprising an AAV capsid variant described herein. In some embodiments, treatment of a neurological disorder and/or neurodegenerative disorder comprises prevention of said neurological disorder and/or neurological disorder.

In some embodiments, the AAV particle (e.g., an AAV particle comprising an AAV capsid variant) of the disclosure is useful for the treatment, prophylaxis, palliation or amelioration of neurological diseases and/or disorders. In some embodiments, the AAV particle of the disclosure (e.g., an AAV particle comprising an AAV capsid variant) is useful for the treatment, prophylaxis, palliation or amelioration of tauopathy.

In some embodiments, the AAV particle of the disclosure (e.g., an AAV particle comprising an AAV capsid variant) is for the treatment, prophylaxis, palliation or amelioration of Alzheimer's Disease. In some embodiments, treatment of Alzheimer's Disease comprises the use of an AAV particle described herein (e.g., an AAV particle comprising an AAV capsid variant described herein) for a gene replacement therapy. In some embodiments, the payload encoded by an AAV particle comprising a capsid variant described herein comprises an ApoE2 protein, ApoE4 protein, an ApoE3 protein, BDNF protein, CYP46A1 protein, Klotho protein, fractalkine (FKN) protein, neprilysin protein (NEP), CD74 protein, caveolin-1, or a combination or variant thereof. In some embodiments, treatment of Alzheimer's Disease comprises the use of an AAV particle described herein (e.g., an AAV particle comprising an AAV capsid variant described herein) for a reduction in the expression of a tau gene and/or protein, a synuclein gene and/or protein, or a combination or variant thereof. In some embodiments, the payload encoded by an AAV particle comprising a capsid variant described herein comprises an antibody that binds to tau or synuclein, an RNAi agent for inhibiting tau or synuclein, a gene editing system (e.g., a CRISPR-Cas system) for altering tau or synuclein expression, or a combination thereof.

In some embodiments, the AAV particle of the disclosure (e.g., an AAV particle comprising an AAV capsid variant) is useful the treatment, prophylaxis, palliation or amelioration of Friedreich's ataxia, or any disease stemming from a loss or partial loss of frataxin protein.

In some embodiments, the AAV particle of the disclosure (e.g., an AAV particle comprising an AAV capsid variant) is for the treatment, prophylaxis, palliation or amelioration of frontal temporal dementia. In some embodiments, treatment of frontal temporal dementia comprises the use of an AAV particle described herein (e.g., an AAV particle comprising an AAV capsid variant described herein) for a gene replacement therapy. In some embodiments, the payload encoded by an AAV particle comprising a capsid variant described herein comprises a progranulin protein or variant thereof.

In some embodiments, the AAV particle of the disclosure (e.g., an AAV particle comprising an AAV capsid variant) is useful for the treatment, prophylaxis, palliation or amelioration of Parkinson's Disease. In some embodiments, treatment of Parkinson's disease comprises the use of an AAV particle described herein (e.g., an AAV particle comprising an AAV capsid variant described herein) for a gene replacement therapy. In some embodiments, the payload encoded by an AAV particle comprising a capsid variant described herein comprises an AADC protein, GAD protein, GDNF protein, TH-GCH1 protein, GBA protein, AIMP2-DX2 protein, or a combination or variant thereof. In some embodiments, treatment of Parkinson's disease comprises the use of an AAV particle described herein (e.g., an AAV particle comprising an AAV capsid variant described herein) for a gene knock-down therapy or a gene editing therapy (e.g., knock-out, repression, or correction). In some embodiments, the payload encoded by an AAV particle comprising a capsid variant described herein comprises a modulator, e.g., an RNAi agent or a CRISPR-Cas system, for altering expression of an alpha-synuclein gene, mRNA, and/or protein, or variant thereof. In some embodiments, the AAV particle of the disclosure (e.g., an AAV particle comprising an AAV capsid variant) is useful for the treatment, prophylaxis, palliation or amelioration of an AADC deficiency. In some embodiments, treatment of AADC deficiency comprises the use of an AAV particle described herein (e.g., an AAV particle comprising an AAV capsid variant described herein) for a gene replacement therapy. In some embodiments, the payload encoded by an AAV particle comprising a capsid variant described herein comprises an AADC protein or variant thereof.

In some embodiments, the AAV particle of the disclosure (e.g., an AAV particle comprising an AAV capsid variant) is useful for the treatment, prophylaxis, palliation or amelioration of Amyotrophic lateral sclerosis. In some embodiments, treatment of ALS comprises the use of an AAV particle described herein (e.g., an AAV particle comprising an AAV capsid variant described herein) for a gene replacement therapy. In some embodiments, the payload encoded by an AAV particle comprising a capsid variant described herein comprises a TDP-43 protein, UPF1 protein, C9orf72 protein, CCNF protein, HSF1 protein, Factor H protein, NGF protein, ADAR2 protein, GDNF protein, VEGF protein, HGF protein, NRTN protein, AIMP2-DX2 protein, or a combination or variant thereof. In some embodiments, treatment of ALS comprises the use of an AAV particle described herein (e.g., an AAV particle comprising an AAV capsid variant described herein) for a gene knock-down therapy or a gene editing therapy (e.g., knock-out, repression, or correction). In some embodiments, the payload encoded by an AAV particle comprising a capsid variant described herein comprises a modulator, e.g., an RNAi agent or a CRISPR-Cas system, for altering expression of a SOD1 or C9ORF72 gene, mRNA, and/or protein, or a combination or variant thereof.

In some embodiments, the AAV particle of the disclosure (e.g., an AAV particle comprising an AAV capsid variant) is useful for the treatment, prophylaxis, palliation or amelioration of Huntington's Disease. In some embodiments, treatment of ALS comprises the use of an AAV particle described herein (e.g., an AAV particle comprising an AAV capsid variant described herein) for a gene knock-down (e.g., knock-out) therapy or a gene editing therapy (e.g., knock-out, repression, or correction). In some embodiments, the payload encoded by an AAV particle comprising a capsid variant described herein comprises a modulator, e.g., an RNAi agent or a CRISPR-Cas system, for altering expression of an HTT gene, mRNA, and/or protein, or a variant thereof.

In some embodiments, the AAV particle of the disclosure (e.g., an AAV particle comprising an AAV capsid variant) is useful for the treatment, prophylaxis, palliation or amelioration of spinal muscular atrophy. In some embodiments, treatment of spinal muscular atrophy comprises the use of an AAV particle described herein (e.g., an AAV particle comprising an AAV capsid variant described herein) for a gene replacement therapy. In some embodiments, the payload encoded by an AAV particle comprising a capsid variant described herein comprises an SMN1 protein, an SMN2 protein, or a combination or variant thereof.

In some embodiments, the AAV particle of the disclosure (e.g., an AAV particle comprising an AAV capsid variant) is useful for the treatment, prophylaxis, palliation or amelioration of multiple system atrophy. In some embodiments, treatment of multiple system atrophy comprises the use of an AAV particle described herein (e.g., an AAV particle comprising an AAV capsid variant described herein) for a gene replacement therapy.

In some embodiments, the AAV particle of the disclosure (e.g., an AAV particle comprising an AAV capsid variant) is useful for the treatment, prophylaxis, palliation or amelioration of Gaucher disease (GD) (e.g., Type 1 GD, Type 2 GD, or Type 3 GD). In some embodiments, the AAV particle of the disclosure (e.g., an AAV particle comprising an AAV capsid variant) is useful for the treatment, prophylaxis, palliation or amelioration of Parkinson's disease associated with a GBA mutation. In some embodiments, the AAV particle of the disclosure (e.g., an AAV particle comprising an AAV capsid variant) is useful for the treatment, prophylaxis, palliation or amelioration of dementia with Lewy Bodies (DLB).

In some embodiments, the AAV particle of the disclosure (e.g., an AAV particle comprising an AAV capsid variant) is useful for treatment, prophylaxis, palliation or amelioration of a leukodystrophy, e.g., Alexander disease, autosomal dominant leukodystrophy with autonomic diseases (ADLD), Canavan disease, cerebrotendinous xanthomatosis (CTX), metachromatic leukodystrophy (MLD), Pelizaeus-Merzbacher disease, or Refsum disease. In some embodiments, treatment of MLD comprises the use of an AAV particle described herein (e.g., an AAV particle comprising an AAV capsid variant described herein) for a gene replacement therapy. In some embodiments, the payload encoded by an AAV particle comprising a capsid variant described herein comprises an ARSA protein or variant thereof. In some embodiments, treatment of ALD comprises the use of an AAV particle described herein (e.g., an AAV particle comprising an AAV capsid variant described herein) for a gene replacement therapy. In some embodiments, the payload encoded by an AAV particle comprising a capsid variant described herein comprises an ABCD-1 protein or variant thereof.

In some embodiments, the AAV particle of the disclosure (e.g., an AAV particle comprising an AAV capsid variant) is useful for the treatment, prophylaxis, palliation, or amelioration of megalencephalic leukoencephalopathy (MLC). In some embodiments, treatment of MLC comprises the use of an AAV particle described herein (e.g., an AAV particle comprising an AAV capsid variant described herein) for a gene replacement therapy. In some embodiments, the payload encoded by an AAV particle comprising a capsid variant described herein comprises an MLC1 protein or variant thereof.

In some embodiments, the AAV particle of the disclosure (e.g., an AAV particle comprising an AAV capsid variant) is useful for the treatment, prophylaxis, palliation, or amelioration of Krabbe disease. In some embodiments, treatment of Krabbe disease comprises the use of an AAV particle described herein (e.g., an AAV particle comprising an AAV capsid variant described herein) for a gene replacement therapy. In some embodiments, the payload encoded by an AAV particle comprising a capsid variant described herein comprises a GALC protein or variant thereof.

In some embodiments, the AAV particle of the disclosure (e.g., an AAV particle comprising an AAV capsid variant) is useful for the treatment, prophylaxis, palliation, or amelioration of Mucopolysaccharidosis, e.g., a Type I (MPS I), Type II (MPS II), Type IIIA (MPS IIIA), Type IIIB (MPS IIIB), or Type IIIC (MPS IIIC). In some embodiments, treatment of Mucopolysaccharidosis comprises the use of an AAV particle described herein (e.g., an AAV particle comprising an AAV capsid variant described herein) for a gene replacement therapy or a gene editing therapy (e.g., enhancement or correction). In some embodiments, the payload encoded or corrected by an AAV particle comprising a capsid variant described herein comprises an IDUA protein, IDS protein, SGSH protein, NAGLU protein, HGSNAT protein, or a combination or variant thereof.

In some embodiments, the AAV particle of the disclosure (e.g., an AAV particle comprising an AAV capsid variant) is useful for the treatment, prophylaxis, palliation, or amelioration of Batten/NCL. In some embodiments, treatment of Batten/NCL comprises the use of an AAV particle described herein (e.g., an AAV particle comprising an AAV capsid variant described herein) for a gene replacement therapy. In some embodiments, the payload encoded by an AAV particle comprising a capsid variant described herein comprises a CLN1 protein, CLN2 protein, CLN3 protein, CLN5 protein, CLN6 protein, CLN7 protein, CLN8 protein, or a combination or variant thereof.

In some embodiments, the AAV particle of the disclosure (e.g., an AAV particle comprising an AAV capsid variant) is useful for the treatment, prophylaxis, palliation or amelioration of Rett Syndrome. In some embodiments, treatment of Rett Syndrome comprises the use of an AAV particle described herein (e.g., an AAV particle comprising an AAV capsid variant described herein) for a gene replacement therapy. In some embodiments, the payload encoded by an AAV particle comprising a capsid variant described herein comprises an MeCP2 protein or variant thereof.

In some embodiments, the AAV particle of the disclosure (e.g., an AAV particle comprising an AAV capsid variant) is useful for the treatment, prophylaxis, palliation, or amelioration of Angelman Syndrome. In some embodiments, treatment of Angelman Syndrome comprises the use of an AAV particle described herein (e.g., an AAV particle comprising an AAV capsid variant described herein) for a gene replacement therapy. In some embodiments, the payload encoded by an AAV particle comprising a capsid variant described herein comprises a UBE3A protein or variant thereof.

In some embodiments, the AAV particle of the disclosure (e.g., an AAV particle comprising an AAV capsid variant) is useful for the treatment, prophylaxis, palliation, or amelioration of Fragile X Syndrome. In some embodiments, treatment of Fragile X Syndrome comprises the use of an AAV particle described herein (e.g., an AAV particle comprising an AAV capsid variant described herein) for a gene replacement therapy. In some embodiments, the payload encoded by an AAV particle comprising a capsid variant described herein comprises a Reelin protein, a DgkK protein, a FMR1 protein, or a combination or variant thereof.

In some embodiments, the AAV particle of the disclosure (e.g., an AAV particle comprising an AAV capsid variant) is useful for the treatment, prophylaxis, palliation, or amelioration of Canavan Disease. In some embodiments, treatment of Canavan Disease comprises the use of an AAV particle described herein (e.g., an AAV particle comprising an AAV capsid variant described herein) for a gene replacement therapy. In some embodiments, the payload encoded by an AAV particle comprising a capsid variant described herein comprises an ASPA protein or variant thereof.

In some embodiments, the AAV particle of the disclosure (e.g., an AAV particle comprising an AAV capsid variant) is useful for the treatment, prophylaxis, palliation, or amelioration of a Gangliosidosis, e.g., a GM1 Gangliosidosis or a GM2 Gangliosidosis (e.g., Tay Sachs Sandhoff). In some embodiments, treatment of a Gangliosidosis, e.g., a GM1 Gangliosidosis or a GM2 Gangliosidosis (e.g., Tay Sachs Sandhoff), comprises the use of an AAV particle described herein (e.g., an AAV particle comprising an AAV capsid variant described herein) for a gene replacement therapy. In some embodiments, the payload encoded by an AAV particle comprising a capsid variant described herein comprises a GLB1 protein, a HEXA protein, a HEXB protein, a GM2A protein, or a combination or variant thereof.

In some embodiments, the AAV particle of the disclosure (e.g., an AAV particle comprising an AAV capsid variant) is useful for the treatment, prophylaxis, palliation, or amelioration of GM3 Synthase Deficiency. In some embodiments, treatment of GM3 Synthase Deficiency comprises the use of an AAV particle described herein (e.g., an AAV particle comprising an AAV capsid variant described herein) for a gene replacement therapy. In some embodiments, the payload encoded by an AAV particle comprising a capsid variant described herein comprises an ST3GAL5 protein or variant thereof.

In some embodiments, the AAV particle of the disclosure (e.g., an AAV particle comprising an AAV capsid variant) is useful for the treatment, prophylaxis, palliation, or amelioration of a Niemann-Pick disorder, e.g., a Niemann-Pick A or a Niemann-Pick C1 (NPC-1). In some embodiments, treatment of a Niemann-Pick disorder, e.g., a Niemann-Pick A or a Niemann-Pick C1 (NPC-1) comprises the use of an AAV particle described herein (e.g., an AAV particle comprising an AAV capsid variant described herein) for a gene replacement therapy. In some embodiments, the payload encoded by an AAV particle comprising a capsid variant described herein comprises an ASM protein, an NPC1 protein, or variant thereof.

In some embodiments, the AAV particle of the disclosure (e.g., an AAV particle comprising an AAV capsid variant) is useful for the treatment, prophylaxis, palliation, or amelioration of Schwannoma (e.g., Neuroma). In some embodiments, treatment of Schwannoma (e.g., Neuroma) comprises the use of an AAV particle described herein (e.g., an AAV particle comprising an AAV capsid variant described herein) for a gene replacement therapy. In some embodiments, the payload encoded by an AAV particle comprising a capsid variant described herein comprises a Caspase-1 protein or variant thereof.

In some embodiments, the AAV particle of the disclosure (e.g., an AAV particle comprising an AAV capsid variant) is useful for the treatment, prophylaxis, palliation, or amelioration of a Tuberous Sclerosis, e.g., Tuberous Sclerosis Type 1 or Tuberous Sclerosis Type 2. In some embodiments, treatment of Tuberous Sclerosis, e.g., Tuberous Sclerosis Type 1 or Tuberous Sclerosis Type 2 comprises the use of an AAV particle described herein (e.g., an AAV particle comprising an AAV capsid variant described herein) for a gene replacement therapy. In some embodiments, the payload encoded by an AAV particle comprising a capsid variant described herein comprises a TSC1 protein, a TSC2 protein, or variant thereof.

In some embodiments, the AAV particle of the disclosure (e.g., an AAV particle comprising an AAV capsid variant) is useful for the treatment, prophylaxis, palliation, or amelioration of a CDKL5 Deficiency. In some embodiments, treatment of a CDKL5 Deficiency comprises the use of an AAV particle described herein (e.g., an AAV particle comprising an AAV capsid variant described herein) for a gene replacement therapy. In some embodiments, the payload encoded by an AAV particle comprising a capsid variant described herein comprises a CDKL5 protein or variant thereof.

In some embodiments, the AAV particle of the disclosure (e.g., an AAV particle comprising an AAV capsid variant) is useful for the treatment, prophylaxis, palliation, or amelioration of a Charcot-Marie-Tooth disorder, e.g., a Charcot-Marie-Tooth Type 1X (CMT1X) disorder, a Charcot-Marie-Tooth Type 2A (CMT2A) disorder, or a Charcot-Marie-Tooth Type 4J (CMT4J) disorder. In some embodiments, treatment of a Charcot-Marie-Tooth disorder, e.g., a Charcot-Marie-Tooth Type 1X (CMT1X) disorder, a Charcot-Marie-Tooth Type 2A (CMT2A) disorder, or a Charcot-Marie-Tooth Type 4J (CMT4J) disorder, comprises the use of an AAV particle described herein (e.g., an AAV particle comprising an AAV capsid variant described herein) for a gene replacement therapy. In some embodiments, the payload encoded by an AAV particle comprising a capsid variant described herein comprises a GJB1 protein, a MFN2 protein, a FIG4 protein, or variant thereof.

In some embodiments, the AAV particle of the disclosure (e.g., an AAV particle comprising an AAV capsid variant) is useful for the treatment, prophylaxis, palliation, or amelioration of an Aspartylglucosaminuria (AGU). In some embodiments, treatment of an AGU comprises the use of an AAV particle described herein (e.g., an AAV particle comprising an AAV capsid variant described herein) for a gene replacement therapy. In some embodiments, the payload encoded by an AAV particle comprising a capsid variant described herein comprises an AGA protein or variant thereof.

In some embodiments, the AAV particle of the disclosure (e.g., an AAV particle comprising an AAV capsid variant) is useful for the treatment, prophylaxis, palliation, or amelioration of a Leigh Syndrome. In some embodiments, treatment of a Leigh Syndrome comprises the use of an AAV particle described herein (e.g., an AAV particle comprising an AAV capsid variant described herein) for a gene replacement therapy. In some embodiments, the payload encoded by an AAV particle comprising a capsid variant described herein comprises a SURF1 protein or variant thereof.

In some embodiments, the AAV particle of the disclosure (e.g., an AAV particle comprising an AAV capsid variant) is useful for the treatment, prophylaxis, palliation, or amelioration of epilepsy. In some embodiments, treatment of epilepsy comprises the use of an AAV particle described herein (e.g., an AAV particle comprising an AAV capsid variant described herein) for a gene replacement therapy. In some embodiments, the payload encoded by an AAV particle comprising a capsid variant described herein comprises an NPY/Y2 protein, a Galanin protein, a Dynorphin protein, an AIMP2-DX2 protein, an SLC6A1 protein, an SLC13A5 protein, a KCNQ2 protein, or variant thereof.

In some embodiments, the AAV particle of the disclosure (e.g., an AAV particle comprising an AAV capsid variant) is useful for the treatment, prophylaxis, palliation, or amelioration of a Dravet Syndrome. In some embodiments, treatment of Dravet Syndrome comprises the use of an AAV particle described herein (e.g., an AAV particle comprising an AAV capsid variant described herein) for a gene replacement therapy. In some embodiments, the payload encoded by an AAV particle comprising a capsid variant described herein comprises an SCN1a protein, or variant thereof.

In some embodiments, the AAV particle of the disclosure (e.g., an AAV particle comprising an AAV capsid variant) is useful for the treatment, prophylaxis, palliation, or amelioration of a Duchenne muscular dystrophy (DMD). In some embodiments, treatment of DMD comprises the use of an AAV particle described herein (e.g., an AAV particle comprising an AAV capsid variant described herein) for a gene replacement therapy or enhancement (e.g., correction of exon-skipping), or a gene editing therapy (e.g., enhancement or correction). In some embodiments, the payload encoded or corrected by an AAV particle comprising a capsid variant described herein comprises a Dystrophin gene and/or protein, a Utrophin gene and/or protein, or a GALGT2 gene and/or protein, or a Follistatin gene and/or protein, or a combination or variant thereof.

In some embodiments, the AAV particle of the disclosure (e.g., an AAV particle comprising an AAV capsid variant) is useful for the treatment, prophylaxis, palliation, or amelioration of Pompe Disease. In some embodiments, treatment of Pompe Disease comprises the use of an AAV particle described herein (e.g., an AAV particle comprising an AAV capsid variant described herein) for a gene replacement therapy. In some embodiments, the payload encoded by an AAV particle comprising a capsid variant described herein comprises a GAA protein, or variant thereof.

In some embodiments, the AAV particle of the disclosure (e.g., an AAV particle comprising an AAV capsid variant) is useful for the treatment, prophylaxis, palliation, or amelioration of Limb-Girdle Muscular Dystrophy (LGMD2A). In some embodiments, treatment of LGMD2A comprises the use of an AAV particle described herein (e.g., an AAV particle comprising an AAV capsid variant described herein) for a gene replacement therapy. In some embodiments, the payload encoded by an AAV particle comprising a capsid variant described herein comprises a CAPN-3 protein, DYSF protein, a SGCG protein, a SGCA protein, a SGCB protein, a FKRP protein, a ANO5 protein, or a combination or variant thereof.

In some embodiments, the AAV particle of the disclosure (e.g., an AAV particle comprising an AAV capsid variant) is useful for the treatment, prophylaxis, palliation or amelioration of chronic or neuropathic pain.

In some embodiments, the AAV particle of the disclosure (e.g., an AAV particle comprising AAV capsid variant) is useful for treatment, prophylaxis, palliation or amelioration of a disease associated with the central nervous system.

In some embodiments, the AAV particle of the disclosure (e.g., an AAV particle comprising an AAV capsid variant) is useful for treatment, prophylaxis, palliation or amelioration of a disease associated with the peripheral nervous system.

In some embodiments, provided herein is a method for treating a neuro-oncological disorder in a subject, comprising administering to the subject an effective amount of a pharmaceutical composition described herein or an AAV particle, e.g., a plurality of particles, comprising an AAV capsid variant described herein. In some embodiments, treatment of a neuro-oncological disorder comprises prevention of said neuro-oncological disorder. In some embodiments, a neuro-oncological disorder comprises a cancer of a primary CNS origin (e.g., a CNS cell, a tissue, or a region), or a metastatic cancer in a CNS cell, tissue, or region. Examples of primary CNS cancers could be gliomas (which may include glioblastoma (also known as glioblastoma multiforme), astrocytomas, oligodendrogliomas, and ependymomas, and mixed gliomas), meningiomas, medulloblastomas, neuromas, and primary CNS lymphoma (in the brain, spinal cord, or meninges), among others. Examples of metastatic cancers include those originating in another tissue or organ, e.g., breast, lung, lymphoma, leukemia, melanoma (skin cancer), colon, kidney, prostate, or other types that metastasize to brain.

In some embodiments, the AAV particle of the disclosure (e.g., an AAV particle comprising an AAV capsid variant) is useful for the treatment, prophylaxis, palliation or amelioration of a disease associated with expression of HER2, e.g., a disease associated with overexpression of HER2. In some embodiments, the AAV particle of the disclosure (e.g., an AAV particle comprising an AAV capsid variant) is useful for the treatment, prophylaxis, palliation or amelioration of a HER2-positive cancer. In some embodiments, the HER2-positive cancer is a HER2-positive solid tumor. Additionally, or alternatively, the HER2-positive cancer may be a locally advanced or metastatic HER2-positive cancer. In some instances, the HER2-positive cancer is a HER2-positive breast cancer or a HER2-positive gastric cancer. In some embodiments, the HER2-positive cancer is selected from the group consisting of a HER2-positive gastroesophageal junction cancer, a HER2-positive colorectal cancer, a HER2-positive lung cancer (e.g., a HER2-positive non-small cell lung carcinoma), a HER2-positive pancreatic cancer, a HER2-positive colorectal cancer, a HER2-positive bladder cancer, a HER2-positive salivary duct cancer, a HER2-positive ovarian cancer (e.g., a HER2-positive epithelial ovarian cancer), or a HER2-positive endometrial cancer. In some instances, the HER2-positive cancer is prostate cancer. In some embodiments, the HER2-positive cancer has metastasized to the central nervous system (CNS). In some instances, the metastasized HER2-cancer has formed CNS neoplasms.

In some embodiments, the AAV particle of the present disclosure (e.g., an AAV particle comprising an AAV capsid polypeptide, e.g., an AAV capsid variant) is administered to a subject having at least one of the diseases or symptoms described herein. In some embodiments, an AAV particle of the present disclosure is administered to a subject having or diagnosed with having a disease or disorder described herein.

In some embodiments, provided herein is a method for treating a muscular disorder and/or neuromuscular disorder in a subject, comprising administering to the subject an effective amount of a pharmaceutical composition described herein or an AAV particle, e.g., a plurality of particles, comprising an AAV capsid variant described herein. In some embodiments, treatment of a muscular disorder and/or neuromuscular disorder comprises prevention of said muscular disorder and/or neuromuscular disorder.

In some embodiments, the AAV particle of the disclosure (e.g., an AAV particle comprising an AAV capsid variant) is useful for treatment, prophylaxis, palliation or amelioration of a cardiac disease or heart disease and/or method of improving (e.g., enhancing) cardiac function in a subject. In some embodiments, the cardiac disease is a cardiomyopathy (e.g., arrhythmogenic right ventricular cardiomyopathy, dilated cardiomyopathy, or hypertrophic cardiomyopathy), congestive heart failure, tachycardia (e.g., catecholaminergic polymorphic ventricular tachycardia), ischemic heart disease, and/or myocardial infarction. In some embodiments, the cardiac disease is a disease associated with expression, e.g., aberrant expression, of LAMP2B, MYBPC3, TNNI3, LMNA, BAG3, DWORF, PKP2, Cx43, TAZ, CASQ2, SERCA2a, I-1c, S100A1 and/or ARC, S100A1, ASCL1, miR133, Mydelta3, Sav, or a combination or variant thereof. In some embodiments, treatment of a cardiac disorder described herein comprises the use of an AAV particle described herein (e.g., an AAV particle comprising an AAV capsid variant described herein) for a gene replacement therapy.

In some embodiments, the cardiac disease is a genetic disorder, e.g., an autosomal dominant genetic disorder, an autosomal recessive disorder, or an X-linked recessive genetic disorder. In some embodiments, the cardiomyopathy is a genetic disorder, e.g., a genetic disorder associated with an abnormality (e.g., mutation, insertion, rearrangement and/or deletion) in a gene chosen from TTN, LMNA, MYH7, MYH6, SCN5A, TNNT2, RBM20, TNNI3, MYL2, MYL3, PKP2, DSP, DSG2, DSC2, JUP, or a combination thereof. In some embodiments, the cardiac disorder is a dilated cardiomyopathy, e.g., a dilated cardiomyopathy associated with an abnormality (e.g., mutation, insertion, rearrangement and/or deletion) in a gene chosen from TTN, LMNA, MIH7, BAG3, MIPN, TNNT2, SCN5A, RBN20, TNPO, LAMA4, VCL, LDB3, TCAP, PSEN1/2, ACTN2, CRYAB, TPM1, ABCC9, ACTC1, PDLIM3, ILK, TNNC1, TNNI3, PLN, DES, SGCD, CSRP3, MIH6, EYA4, ANKRD1, DMD, GATAD1, TAZ/G4.5, or combination thereof. In some embodiments, the cardiac disorder is a hypertrophic cardiomyopathy, e.g., a hypertrophic cardiomyopathy associated with an abnormality (e.g., mutation, insertion, rearrangement and/or deletion) in a gene chosen from MYH7, TNNT2, TNNI3, TPM1, MYL2, MYL3, ACTC1, CSRP3, TTN, ACTN2, MYH6, TCAP, TNNC1, or a combination thereof. In some embodiments, the cardiac disorder is an arrhythmogenic ventricular cardiomyopathy, e.g., an arrhythmogenic ventricular cardiomyopathy associated with an abnormality (e.g., mutation, insertion, rearrangement and/or deletion) in a gene chosen from PKP2, DSG2, DSP, RYR2, DSC2, TGFB3, TMEM43, DES, TTN, LMNA, or a combination thereof.

In some embodiments, the AAV particle of the present disclosure (e.g., an AAV particle comprising an AAV capsid polypeptide, e.g., an AAV capsid variant) is administered to a subject having at least one of the diseases or symptoms described herein. In some embodiments, an AAV particle of the present disclosure is administered to a subject having or diagnosed with having a disease or disorder described herein.

Any neurological disease or disorder, neurodegenerative disorder, muscular disorder, neuromuscular disorder, and/or neuro-oncological disorder may be treated with the AAV particles of the disclosure, or pharmaceutical compositions thereof.

Pharmaceutical Composition and Formulations

According to the present disclosure, an AAV particle comprising an AAV capsid variant described herein may be prepared as a pharmaceutical composition. In some embodiments, the pharmaceutical composition comprises at least one active ingredients. In some embodiments, the pharmaceutical composition comprises a pharmaceutically acceptable excipient.

In some embodiments, an AAV particle of the present disclosure (e.g., an AAV particle comprising an AAV capsid polypeptide, e.g., an AAV capsid variant) can be formulated using an excipient to: (1) increase stability; (2) increase cell transfection or transduction; (3) permit the sustained or delayed expression of the payload; (4) alter the biodistribution (e.g., target the viral particle to specific tissues or cell types); (5) increase the translation of encoded protein; (6) alter the release profile of encoded protein; and/or (7) allow for regulatable expression of the payload. Formulations of the present disclosure can include, without limitation, saline, liposomes, lipid nanoparticles, polymers, peptides, proteins, cells transfected with viral vectors (e.g., for transfer or transplantation into a subject) and combinations thereof.

In some embodiments, the relative amount of the active ingredient (e.g. an AAV particle comprising an AAV capsid variant described herein), a pharmaceutically acceptable excipient, and/or any additional ingredients in a pharmaceutical composition in accordance with the present disclosure may vary, depending upon the identity, size, and/or condition of the subject being treated and further depending upon the route by which the composition is to be administered. For example, the composition may comprise between 0.1% and 99% (w/w) of the active ingredient. By way of example, the composition may comprise between 0.1% and 100%, e.g., between 0.5 and 50%, between 1-30%, between 5-80%, at least 80% (w/w) active ingredient.

In some embodiments, the pharmaceutical composition comprising an AAV particle described herein may comprise an AAV capsid variant and a viral genome encoding a payload, e.g., a payload described herein, with or without a pharmaceutically acceptable excipient.

The present disclosure also provides in some embodiments, a pharmaceutical composition suitable for administration to a subject, e.g., a human. In some embodiments, the pharmaceutical composition is administered to a subject, e.g., a human.

Administration

In some embodiments, an AAV particle disclosed herein (e.g., an AAV particle comprising an AAV capsid variant) may be administered to a subject by a delivery route, e.g., a localized delivery route or a systemic delivery route.

In some embodiments, an AAV particle described herein (e.g., an AAV particle comprising an AAV capsid variant) may be administered via such a route that it is able to cross the blood-brain barrier, vascular barrier, or other epithelial barrier. In some embodiments, an AAV particle of the present disclosure (e.g., an AAV particle comprising an AAV capsid variant) may be administered in any suitable form, either as a liquid solution or suspension, as a solid form suitable for liquid solution or suspension in a liquid solution. In some embodiments, an AAV particle (e.g., an AAV particle comprising an AAV capsid variant) may be formulated with any appropriate and pharmaceutically acceptable excipient.

In some embodiments, the AAV particle described herein (e.g., an AAV particle comprising an AAV capsid variant) is administered intramuscularly, intravenously, intracerebrally, intrathecally, intratumorally, intracerebroventricularly, via intraparenchymal administration, or via intra-cisterna magna injection (ICM). In some embodiments, the AAV particle described herein (e.g., an AAV particle comprising an AAV capsid variant) is administered intravenously. In some embodiments, the AAV particle described herein (e.g., an AAV particle comprising an AAV capsid variant) is administered via intra-cisterna magna injection (ICM). In some embodiments, the AAV particle described herein (e.g., an AAV particle comprising an AAV capsid variant) is administered intratumorally. In some embodiments, the AAV particle described herein (e.g., an AAV particle comprising an AAV capsid variant) is administered intraarterially.

In some embodiments, an AAV particle of the present disclosure (e.g., an AAV particle comprising an AAV capsid variant) may be delivered to a subject via a single route administration. In some embodiments, an AAV particle of the present disclosure may be delivered to a subject via a multi-site route of administration. In some embodiments, a subject may be administered at 2, 3, 4, 5, or more than 5 sites.

In some embodiments, an AAV particle of the present disclosure (e.g., an AAV particle comprising an AAV capsid variant) is administered via a bolus infusion. In some embodiments, an AAV particle of the present disclosure is administered via sustained delivery over a period of minutes, hours, or days. In some embodiments, the infusion rate may be changed depending on the subject, distribution, formulation, and/or another delivery parameter. In some embodiments, an AAV particle of the present disclosure is administered using a controlled release. In some embodiments, an AAV particle of the present disclosure is administered using a sustained release, e.g., a release profile that conforms to a release rate over a specific period of time.

In some embodiments, an AAV particle (e.g., an AAV particle comprising an AAV capsid variant) may be delivered by more than one route of administration. As non-limiting examples of combination administrations, an AAV particle may be delivered by intrathecal and intracerebroventricular, or by intravenous and intraparenchymal administration.

Intravenous Administration

In some embodiments, an AAV particle described herein (e.g., an AAV particle comprising an AAV capsid variant) may be administered to a subject by systemic administration. In some embodiments, the systemic administration is intravenous administration. In another embodiment, the systemic administration is intraarterial administration. In some embodiments, an AAV particle of the present disclosure may be administered to a subject by intravenous administration. In some embodiments, the intravenous administration may be achieved by subcutaneous delivery. In some embodiments, the AAV particle is administered to the subject via focused ultrasound (FUS), e.g., coupled with the intravenous administration of microbubbles (FUS-MB) or MRI-guided FUS coupled with intravenous administration, e.g., as described in Terstappen et al. (Nat Rev Drug Discovery, doi.org/10.1038/s41573-021-00139-y (2021)), the contents of which are incorporated herein by reference in its entirety. In some embodiments, the AAV particle is administered to the subject intravenously. In some embodiments, the subject is a human.

Administration to the CNS

In some embodiments, an AAV particle described herein (e.g., an AAV particle comprising an AAV capsid variant) may be delivered by direct injection into the brain. As a non-limiting example, the brain delivery may be by intrahippocampal administration. In some embodiments, an AAV particle of the present disclosure may be administered to a subject by intraparenchymal administration. In some embodiments, the intraparenchymal administration is to tissue of the central nervous system. In some embodiments, an AAV particle of the present disclosure may be administered to a subject by intracranial delivery (See, e.g., U.S. Pat. No. 8,119,611; the content of which is incorporated herein by reference in its entirety). In some embodiments, an AAV particle described herein may be delivered by injection into the CSF pathway. Non-limiting examples of delivery to the CSF pathway include intrathecal and intracerebroventricular administration. In some embodiments, an AAV particle described herein may be administered via intracisternal magna (ICM) injection.

In some embodiments, an AAV particle of the present disclosure (e.g., an AAV particle comprising an AAV capsid variant) may be delivered to the brain by systemic delivery. As a non-limiting example, the systemic delivery may be by intravascular administration. As a non-limiting example, the systemic or intravascular administration may be intravenous.

In some embodiments, an AAV particle (e.g., an AAV particle comprising an AAV capsid variant) of the present disclosure may be delivered by an intraocular delivery route. A non-limiting example of an intraocular administration includes an intravitreal injection.

Intramuscular Administration

In some embodiments, an AAV particle described herein (e.g., an AAV particle comprising an AAV capsid variant) may be delivered by intramuscular administration. Without wishing to be bound by theory, it is believed in some embodiments, that the multi-nucleated nature of muscle cells provides an advantage to gene transduction subsequent to AAV delivery. In some embodiments, cells of the muscle are capable of expressing recombinant proteins with the appropriate post-translational modifications. Without wishing to be bound by theory, it is believed in some embodiments, the enrichment of muscle tissue with vascular structures allows for transfer to the blood stream and whole-body delivery. Examples of intramuscular administration include systemic (e.g., intravenous), subcutaneous or directly into the muscle. In some embodiments, more than one injection is administered. In some embodiments, an AAV particle of the present disclosure may be delivered by an intramuscular delivery route. (See, e.g., U.S. Pat. No. 6,506,379; the content of which is incorporated herein by reference in its entirety). Non-limiting examples of intramuscular administration include an intravenous injection or a subcutaneous injection.

In some embodiments, an AAV particle of the present disclosure (e.g., an AAV particle comprising an AAV capsid variant) is administered to a subject and transduces the muscle of a subject. As a non-limiting example, an AAV particle is administered by intramuscular administration. In some embodiments, an AAV particle of the present disclosure may be administered to a subject by subcutaneous administration. In some embodiments, the intramuscular administration is via systemic delivery. In some embodiments, the intramuscular administration is via intravenous delivery. In some embodiments, the intramuscular administration is via direct injection to the muscle.

In some embodiments, the muscle is transduced by administration, e.g., intramuscular administration. In some embodiments, an intramuscular delivery comprises administration at one site. In some embodiments, an intramuscular delivery comprises administration at more than one site. In some embodiments, an intramuscular delivery comprises administration at two, three, four, or more sites. In some embodiments, intramuscular delivery is combined with at least one other method of administration.

In some embodiments, an AAV particle pf the present disclosure (e.g., an AAV particle comprising an AAV capsid variant) may be administered to a subject by peripheral injections. Non-limiting examples of peripheral injections include intraperitoneal, intramuscular, intravenous, conjunctival, or joint injection. It was disclosed in the art that the peripheral administration of AAV vectors can be transported to the central nervous system, for example, to the motor neurons (e.g., U. S. Patent Publication Nos. US20100240739 and US20100130594; the content of each of which is incorporated herein by reference in their entirety).

In some embodiments, an AAV particle of the present disclosure (e.g., an AAV particle comprising an AAV capsid variant) may be administered to a subject by intraparenchymal administration. In some embodiments, the intraparenchymal administration is to muscle tissue. In some embodiments, an AAV particle of the present disclosure is delivered as described in Bright et al 2015 (Neurobiol Aging. 36(2): 693-709), the contents of which are herein incorporated by reference in their entirety. In some embodiments, an AAV particle of the present disclosure is administered to the gastrocnemius muscle of a subject. In some embodiments, an AAV particle of the present disclosure is administered to the bicep femorii of the subject. In some embodiments, an AAV particles of the present disclosure is administered to the tibialis anterior muscles. In some embodiments, an AAV particle of the present disclosure is administered to the soleus muscle.

Depot Administration

In some embodiments, a pharmaceutical composition and/or an AAV particle of the present disclosure (e.g., an AAV particle comprising an AAV capsid variant) are formulated in depots for extended release. Generally, specific organs or tissues are targeted for administration.

In some embodiments, a pharmaceutical composition and/or an AAV particle of the present disclosure (e.g., an AAV particle comprising an AAV capsid variant) are spatially retained within or proximal to target tissues. Provided are methods of providing a pharmaceutical composition, an AAV particle, to target tissues of mammalian subjects by contacting target tissues (which comprise one or more target cells) with the pharmaceutical composition and/or the AAV particle, under conditions such that they are substantially retained in target tissues, e.g., such that at least 10, 20, 30, 40, 50, 60, 70, 80, 85, 90, 95, 96, 97, 98, 99, 99.9, 99.99 or greater than 99.99% of the composition is retained in the target tissues. In some embodiments, retention is determined by measuring the amount of pharmaceutical composition and/or AAV particle, that enter a target cell or a plurality of target cells. For example, at least 1%, 5%, 10%, 20%, 30%, 40%, 50%, 60%, 70%, 80%, 85%, 90%, 95%, 96%, 97%, 98%, 99%, 99.9%, 99.99%, or greater than 99.99% of a pharmaceutical composition and/or an AAV particle, administered to a subject are present intracellularly at a period of time following administration. For example, intramuscular injection to a subject may be performed using aqueous compositions comprising a pharmaceutical composition and/or an AAV particle of the present disclosure and a transfection reagent, and retention is determined by measuring the amount of the pharmaceutical composition and/or the AAV particle, present in the muscle cell or plurality of muscle cells.

In some embodiments, disclosed herein are methods of providing a pharmaceutical composition and/or an AAV particle of the present disclosure (e.g., an AAV particle comprising an AAV capsid variant) to a tissue of a subject, by contacting the tissue (comprising a cell, e.g., a plurality of cells) with the pharmaceutical composition and/or the AAV particle under conditions such that they are substantially retained in the tissue. In some embodiments, a pharmaceutical composition and/or AAV particle described herein comprise a sufficient amount of an active ingredient such that the effect of interest is produced in at least one cell. In some embodiments, a pharmaceutical composition and/or an AAV particle generally comprise one or more cell penetration agents. In some embodiments, the disclosure provides a naked formulations (such as without cell penetration agents or other agents), with or without pharmaceutically acceptable carriers.

Methods of Treatment

Provided in the present disclosure are methods for introducing (e.g., delivering) an AAV particle of the present disclosure (e.g., an AAV particle comprising an AAV capsid variant) into cells. In some embodiments, the method comprises introducing into said cells an AAV particle or vector described herein in an amount sufficient to modulate, e.g., increase, the production of a target gene, mRNA, and/or protein. In some embodiments, the method comprises introducing into said cells an AAV particle or vector described herein in an amount sufficient to modulate, e.g., decrease, expression of a target gene, mRNA, and/or protein. In some aspects, the cells may be neurons such as but not limited to, motor, hippocampal, entorhinal, thalamic, cortical, sensory, sympathetic, or parasympathetic neurons, and glial cells such as astrocytes, microglia, and/or oligodendrocytes. In other aspects, the cells may be a muscle cell, e.g., a cell of a diaphragm, a quadriceps, or a heart (e.g., a heart atrium or a heart ventricle). In other embodiments, the cells may be a muscle cell (e.g., a cell of a diaphragm, a quadriceps, or a heart (e.g., a heart atrium or a heart ventricle)) or a liver cell. In some embodiments, the cell may be a heart cell (e.g., a cell of a heart atrium or a cell of a heart ventricle).

Disclosed in the present disclosure are methods for treating a neurological disease/disorder or a neurodegenerative disorder, a muscular or neuromuscular disorder, or a neurooncological disorder associated with aberrant, e.g., insufficient or increased, function/presence of a protein, e.g., a target protein in a subject in need of treatment.

In some embodiments, the method comprises administering to the subject a therapeutically effective amount of a composition comprising AAV particles of the present disclosure. As a non-limiting example, the AAV particles can increase target gene expression, increase target protein production, and thus reduce one or more symptoms of neurological disease in the subject such that the subject is therapeutically treated.

In other embodiments, the method comprises administering to the subject a therapeutically effective amount of a composition comprising AAV particles (e.g., an AAV particle comprising an AAV capsid polypeptide, e.g., an AAV capsid variant) comprising a viral genome with a nucleic acid sequence encoding one or more siRNA molecules. As a non-limiting example, the siRNA molecules can silence target gene expression, inhibit target protein production, and reduce one or more symptoms of neurological disease in the subject such that the subject is therapeutically treated.

In some embodiments, the composition comprising the AAV particles of the present disclosure (e.g., an AAV particle comprising an AAV capsid variant described herein) is administered to the central nervous system of the subject via systemic administration. In some embodiments, the systemic administration is intravenous (IV) injection. In some embodiments, the AAV particle described herein or a pharmaceutical composition comprising an AAV particle described herein is administered by focused ultrasound (FUS), e.g., coupled with the intravenous administration of microbubbles (FUS-MB) or MRI-guided FUS coupled with intravenous administration.

In some embodiments, the composition comprising the AAV particle of the present disclosure (e.g., an AAV particle comprising an AAV capsid variant) is administered to the central nervous system of the subject via intraventricular administration. In some embodiments, the composition comprising the AAV particle of the present disclosure (e.g., an AAV particle comprising an AAV capsid variant) is administered via intra-cisterna magna injection (ICM).

In some embodiments, the composition comprising an AAV particle of the present disclosure (e.g., an AAV particle comprising an AAV capsid variant) is administered to the central nervous system of the subject via intraventricular injection and intravenous injection.

In some embodiments, the composition comprising the AAV particle of the present disclosure (e.g., an AAV particle comprising an AAV capsid variant) is administered to the central nervous system of the subject via ICM injection and intravenous injection at a specific dose per subject. As a non-limiting example, the AAV particles are administered via ICM injection at a dose of $1\times10^4$ VG per subject. As a non-limiting example, the AAV particles are administered via IV injection at a dose of $2\times10^{13}$ VG per subject.

In some embodiments, the composition comprising the AAV particle of the present disclosure (e.g., an AAV particle comprising an AAV capsid variant) is administered to the central nervous system of the subject. In other embodiments, the composition comprising the AAV particles of the present disclosure is administered to a CNS tissue of a subject (e.g., putamen, hippocampus, thalamus, or cortex of the subject).

In some embodiments, the composition comprising the AAV particle of the present disclosure (e.g., an AAV particle comprising an AAV capsid variant) is administered to the central nervous system of the subject via intraparenchymal injection. Non-limiting examples of intraparenchymal injections include intraputamenal, intracortical, intrathalamic, intrastriatal, intrahippocampal or into the entorhinal cortex.

In some embodiments, the composition comprising the AAV particle of the present disclosure (e.g., an AAV particle comprising an AAV capsid variant) is administered to the central nervous system of the subject via intraparenchymal injection and intravenous injection.

In some embodiments, the composition comprising the AAV particle of the present disclosure (e.g., an AAV particle comprising an AAV capsid variant) is administered to the central nervous system of the subject via intraventricular injection, intraparenchymal injection and intravenous injection.

In some embodiments, the composition comprising an AAV particle (e.g., an AAV particle comprising an AAV capsid variant) of a plurality of particles of the present disclosure is administered to a muscle of the subject via intravenous injection. In some embodiments, the composition comprising an AAV particle of a plurality of particles of the present disclosure is administered to a muscle of the subject via intramuscular injection.

In some embodiments, an AAV particle of the present disclosure (e.g., an AAV particle comprising an AAV capsid variant) may be delivered into specific types of cells, including, but not limited to, thalamic, hippocampal, entorhinal, cortical, motor, sensory, excitatory, inhibitory, sympathetic, or parasympathetic neurons; glial cells including oligodendrocytes, astrocytes and microglia; and/or other cells surrounding neurons such as T cells. In some embodiments, an AAV particle of the present disclosure may be delivered into a muscle cell, e.g., a cell of the quadriceps, diaphragm, liver, and/or heart (e.g., heart atrium or heart ventricle).

In some embodiments, an AAV particle (e.g., an AAV particle comprising an AAV capsid polypeptide, e.g., an AAV capsid variant), e.g., a plurality of particles, of the present disclosure may be delivered to a cell or region of the midbrain. In some embodiments, an AAV particle (e.g., an AAV particle comprising an AAV capsid polypeptide, e.g., an AAV capsid variant), e.g., a plurality of particles, of the present disclosure may be delivered to a cell or region of the brains stem.

In some embodiments, an AAV particle (e.g., an AAV particle comprising an AAV capsid polypeptide, e.g., an AAV capsid variant), e.g., a plurality of particles, of the present disclosure may be delivered to neurons in the putamen, hippocampus, thalamus and/or cortex.

In some embodiments, an AAV particle (e.g., an AAV particle comprising an AAV capsid variant), e.g., a plurality of particles, of the present disclosure may be used as a therapy for a genetic disorder, e.g., an autosomal dominant genetic disorder, an autosomal recessive disorder, X-linked dominant genetic disorder, an X-linked recessive genetic disorder, or a Y-linked genetic disorder. In some embodiments, the genetic disorder is a monogenetic disorder or a polygenic disorder. In some embodiments, treatment of a genetic disorder, e.g., a monogenic disorder, comprises the use of an AAV particle described herein (e.g., an AAV particle comprising an AAV capsid variant described herein) for a gene replacement therapy.

In some embodiments, an AAV particle (e.g., an AAV particle comprising an AAV capsid variant), e.g., a plurality of particles, of the present disclosure may be used as a therapy for a neurological disease.

In some embodiments, an AAV particle (e.g., an AAV particle comprising an AAV capsid variant), e.g., a plurality of particles, of the present disclosure may be used as a therapy for tauopathies.

In some embodiments, an AAV particle (e.g., an AAV particle comprising an AAV capsid variant), e.g., a plurality of particles, of the present disclosure may be used as a therapy for Alzheimer's Disease.

In some embodiments, an AAV particle (e.g., an AAV particle comprising an AAV capsid variant), e.g., a plurality of particles, of the present disclosure may be used as a therapy for Amyotrophic Lateral Sclerosis.

In some embodiments, an AAV particle (e.g., an AAV particle comprising an AAV capsid variant), e.g., a plurality of particles, of the present disclosure may be used as a therapy for Huntington's Disease.

In some embodiments, an AAV particle (e.g., an AAV particle comprising an AAV capsid variant), e.g., a plurality of particles, of the present disclosure may be used as a therapy for Parkinson's Disease.

In some embodiments, an AAV particle (e.g., an AAV particle comprising an AAV capsid variant), e.g., a plurality of particles, of the present disclosure may be used as a therapy for Gaucher disease (GD) (e.g., Type 1 GD, Type 2 GD, or Type 3 GD). In some embodiments, an AAV particle (e.g., an AAV particle comprising an AAV capsid variant), e.g., a plurality of particles, of the present disclosure may be used as a therapy for Parkinson's disease associated with a GBA mutation. In some embodiments, an AAV particle (e.g., an AAV particle comprising an AAV capsid variant), e.g., a plurality of particles, of the present disclosure may be used as a therapy for dementia with Lewy Bodies (DLB).

In some embodiments, an AAV particle (e.g., an AAV particle comprising an AAV capsid variant), e.g., a plurality of particles, of the present disclosure may be used as a therapy for spinal muscular atrophy.

In some embodiments, an AAV particle (e.g., an AAV particle comprising an AAV capsid variant), e.g., a plurality of particles, of the present disclosure may be used as a therapy for a leukodystrophy, e.g., Alexander disease, autosomal dominant leukodystrophy with autonomic diseases (ADLD), Canavan disease, cerebrotendinous xanthomatosis (CTX), metachromatic leukodystrophy (MLD), Pelizaeus-Merzbacher disease, or Refsum disease.

In some embodiments, an AAV particle (e.g., an AAV particle comprising an AAV capsid variant), e.g., a plurality of particles, of the present disclosure may be used as a therapy for Friedreich's Ataxia.

In some embodiments, an AAV particle (e.g., an AAV particle comprising an AAV capsid variant), e.g., a plurality of particles, of the present disclosure may be used as a therapy for chronic or neuropathic pain.

In some embodiments, an AAV particle (e.g., an AAV particle comprising an AAV capsid variant), e.g., a plurality of particles, of the present disclosure may be used as a therapy for a muscular disorder or a neuromuscular disorder.

In some embodiments, an AAV particle (e.g., an AAV particle comprising an AAV capsid variant), e.g., a plurality of particles, of the present disclosure may be used as a therapy for a cardiac disease or heart disease and/or method of improving (e.g., enhancing) cardiac function in a subject. In some embodiments, the cardiac disease is a cardiomyopathy (e.g., arrhythmogenic right ventricular cardiomyopathy, dilated cardiomyopathy, or hypertrophic cardiomyopathy), congestive heart failure, tachycardia (e.g., catecholaminergic polymorphic ventricular tachycardia), ischemic heart disease, and/or myocardial infarction.

In some embodiments, an AAV particle (e.g., an AAV particle comprising an AAV capsid variant), e.g., a plurality of particles, of the present disclosure may be used as a therapy for a disease associated with expression of HER2, e.g., a disease associated with overexpression of HER2. In some embodiments, the AAV particle of the disclosure (e.g., an AAV particle comprising an AAV capsid variant) is useful for the treatment, prophylaxis, palliation or amelioration of a HER2-positive cancer. In some embodiments, the HER2-positive cancer is a HER2-positive solid tumor. Additionally, or alternatively, the HER2-positive cancer may be a locally advanced or metastatic HER2-positive cancer. In some instances, the HER2-positive cancer is a HER2-positive breast cancer or a HER2-positive gastric cancer. In some embodiments, the HER2-positive cancer is selected from the group consisting of a HER2-positive gastroesophageal junction cancer, a HER2-positive colorectal cancer, a HER2-positive lung cancer (e.g., a HER2-positive non-small cell lung carcinoma), a HER2-positive pancreatic cancer, a HER2-positive colorectal cancer, a HER2-positive bladder cancer, a HER2-positive salivary duct cancer, a HER2-positive ovarian cancer (e.g., a HER2-positive epithelial ovarian cancer), or a HER2-positive endometrial cancer. In some instances, the HER2-positive cancer is prostate cancer. In some embodiments, the HER2-positive cancer has metastasized to the central nervous system (CNS). In some instances, the metastasized HER2-cancer has formed CNS neoplasms.

In some embodiments, an AAV particle (e.g., an AAV particle comprising an AAV capsid variant) e.g., a plurality of particles, of the present disclosure may be used as a therapy for a neuro-oncological disorder. In some embodiments, the neuro-oncological disorder is a cancer of primary CNS origin (e.g., a cancer of a CNS cell and/or CNS tissue). In some embodiments, the neuro-oncological disorder is metastatic cancer in a CNS cell, CNS region, and/or a CNS tissue. Examples of primary CNS cancers could be gliomas (which may include glioblastoma (also known as glioblastoma multiforme), astrocytomas, oligodendrogliomas, and ependymomas, and mixed gliomas), meningiomas, medulloblastomas, neuromas, and primary CNS lymphoma (in the brain, spinal cord, or meninges), among others. Examples of metastatic cancers include those originating in another tissue or organ, e.g., breast, lung, lymphoma, leukemia, melanoma (skin cancer), colon, kidney, prostate, or other types that metastasize to brain.

In some embodiments, administration of the AAV particle described herein (e.g., an AAV particle comprising an AAV capsid polypeptide, e.g., an AAV capsid variant) to a subject may increase target gene, mRNA, and/or protein levels in a subject, relative to a control, e.g., the gene, mRNA, and/or mRNA levels in the subject prior to receiving AAV particle. The target gene, mRNA, and/or protein levels may be increased by about 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100% in a subject such as, but not limited to, the CNS, a region of the CNS, or a specific cell of the CNS, or a muscle, a region of a muscle, or a cell of a muscle, of a subject. In some embodiments, cell of the CNS comprises an astrocyte, microglia, cortical neuron, hippocampal neuron, DRG and/or sympathetic neuron, sensory neuron, oligodendrocyte, motor neuron, or combination thereof. As a non-limiting example, the AAV particles may increase the gene, mRNA, and/or protein levels of a target protein by fold increases over baseline. In some embodiments, AAV particles lead to 5-6 times higher levels of a target gene, mRNA, or protein.

In some embodiments, administration of the AAV particle described herein (e.g., an AAV particle comprising an AAV capsid polypeptide, e.g., an AAV capsid variant), e.g., an AAV particle comprising a nucleic acid encoding a siRNA molecule, to a subject may decrease target gene, mRNA, and/or protein levels in a subject, relative to a control, e.g., the gene, mRNA, and/or mRNA levels in the subject prior to receiving AAV particle. The target gene, mRNA, and/or protein levels may be decreased by about 30%, 40%, 50%, 60%, 70%, 80%, 85%, 90%, 95% and 100%, or at least 20-30%, 20-40%, 20-50%, 20-60%, 20-70%, 20-80%, 20-90%, 20-95%, 20-100%, 30-40%, 30-50%, 30-60%, 30-70%, 30-80%, 30-90%, 30-95%, 30-100%, 40-50%, 40-60%, 40-70%, 40-80%, 40-90%, 40-95%, 40-100%, 50-60%, 50-70%, 50-80%, 50-90%, 50-95%, 50-100%, 60-70%, 60-80%, 60-90%, 60-95%, 60-100%, 70-80%, 70-90%, 70-95%, 70-100%, 80-90%, 80-95%, 80-100%, 90-95%, 90-100% or 95-100% in a subject such as, but not limited to, the CNS, a region of the CNS, or a specific cell of the CNS, or a muscle, a region of a muscle, or a cell of a muscle, of a subject. In some embodiments, cell of the CNS comprises an astrocyte, microglia, cortical neuron, hippocampal neuron, DRG and/or sympathetic neuron, sensory neuron, oligodendrocyte, motor neuron, or combination thereof. As a non-limiting example, the AAV particles may decrease the gene, mRNA, and/or protein levels of a target protein by fold decreases over baseline.

In some embodiments, the AAV particles of the present disclosure (e.g., an AAV particle comprising an AAV capsid polypeptide, e.g., an AAV capsid variant) may be used to increase target protein and reduce symptoms of neurological disease in a subject. In some embodiments, the AAV particles of the present disclosure (e.g., an AAV particle comprising an AAV capsid polypeptide, e.g., an AAV capsid variant) may be used to decrease target protein and reduce symptoms of neurological disease in a subject.

In some embodiments, the AAV particles of the present disclosure (e.g., an AAV particle comprising an AAV capsid polypeptide, e.g., an AAV capsid variant) may be used to reduce the decline of functional capacity and activities of daily living as measured by a standard evaluation system such as, but not limited to, the total functional capacity (TFC) scale.

In some embodiments, the AAV particles of the present disclosure (e.g., an AAV particle comprising an AAV capsid polypeptide, e.g., an AAV capsid variant) may be used to improve performance on any assessment used to measure symptoms of neurological disease. Such assessments include, but are not limited to ADAS-cog (Alzheimer Disease Assessment Scale-cognitive), MMSE (Mini-Mental State Examination), GDS (Geriatric Depression Scale), FAQ (Functional Activities Questionnaire), ADL (Activities of Daily Living), GPCOG (General Practitioner Assessment of Cognition), Mini-Cog, AMTS (Abbreviated Mental Test Score), Clock-drawing test, 6-CIT (6-item Cognitive Impairment Test), TYM (Test Your Memory), MoCa (Montreal Cognitive Assessment), ACE-R (Addenbrookes Cognitive Assessment), MIS (Memory Impairment Screen), BADLS (Bristol Activities of Daily Living Scale), Barthel Index, Functional Independence Measure, Instrumental Activities of Daily Living, IQCODE (Informant Questionnaire on Cognitive Decline in the Elderly), Neuropsychiatric Inventory, The Cohen-Mansfield Agitation Inventory, BEHAVE-AD, EuroQol, Short Form-36 and/or MBR Caregiver Strain Instrument, or any of the other tests as described in Sheehan B (Ther Adv Neurol Disord. 5(6):349-358 (2012)), the contents of which are herein incorporated by reference in their entirety.

In some embodiments, the present composition is administered as a solo therapeutic or as combination therapeutic for the treatment of a neurological disease/disorder or a neurodegenerative disorder, a muscular disorder or neuromuscular disorder, and/or a neuro-oncological disorder.

The AAV particles (e.g., an AAV particle comprising an AAV capsid variant) encoding the target protein may be used in combination with one or more other therapeutic agents. In some embodiments, compositions can be administered concurrently with, prior to, or subsequent to, additional therapeutic or medical procedures. In general, each agent will be administered at a dose and/or on a time schedule determined for that agent.

Therapeutic agents that may be used in combination with the AAV particles of the present disclosure (e.g., an AAV particle comprising an AAV capsid variant) can be small molecule compounds which are antioxidants, anti-inflammatory agents, anti-apoptosis agents, calcium regulators, anti-glutamatergic agents, structural protein inhibitors, compounds involved in muscle function, and compounds involved in metal ion regulation. As a non-limiting example, the combination therapy may be in combination with one or more neuroprotective agents such as small molecule compounds, growth factors and hormones which have been tested for their neuroprotective effect on motor neuron degeneration.

Compounds tested for treating neurological disease which may be used in combination with the AAV particles described herein include, but are not limited to, cholinesterase inhibitors (donepezil, rivastigmine, galantamine), NMDA receptor antagonists such as memantine, anti-psychotics, anti-depressants, anti-convulsants (e.g., sodium valproate and levetiracetam for myoclonus), secretase inhibitors, amyloid aggregation inhibitors, copper or zinc modulators, BACE inhibitors, inhibitors of tau aggregation, such as Methylene blue, phenothiazines, anthraquinones, n-phenylamines or rhodamines, microtubule stabilizers such as NAP, taxol or paclitaxel, kinase or phosphatase inhibitors such as those targeting GSK3β (lithium) or PP2A, immunization with Aβ peptides or tau phospho-epitopes, anti-tau or anti-amyloid antibodies, dopamine-depleting agents (e.g., tetrabenazine for chorea), benzodiazepines (e.g., clonazepam for myoclonus, chorea, dystonia, rigidity, and/or spasticity), amino acid precursors of dopamine (e.g., levodopa for rigidity), skeletal muscle relaxants (e.g., baclofen, tizanidine for rigidity and/or spasticity), inhibitors for acetylcholine release at the neuromuscular junction to cause muscle paralysis (e.g., botulinum toxin for bruxism and/or dystonia), atypical neuroleptics (e.g., olanzapine and quetiapine for psychosis and/or irritability, risperidone, sulpiride and haloperidol for psychosis, chorea and/or irritability, clozapine for treatment-resistant psychosis, aripiprazole for psychosis with prominent negative symptoms), selective serotonin reuptake inhibitors (SSRIs) (e.g., citalopram, fluoxetine, paroxetine, sertraline, mirtazapine, venlafaxine for depression, anxiety, obsessive compulsive behavior and/or irritability), hypnotics (e.g., xopiclone and/or zolpidem for altered sleep-wake cycle), anticonvulsants (e.g., sodium valproate and carbamazepine for mania or hypomania) and mood stabilizers (e.g., lithium for mania or hypomania).

Neurotrophic factors may be used in combination therapy with the AAV particles of the present disclosure (e.g., an AAV particle comprising an AAV capsid variant) for treating neurological disease. Generally, a neurotrophic factor is defined as a substance that promotes survival, growth, differentiation, proliferation and/or maturation of a neuron, or stimulates increased activity of a neuron. In some embodiments, the present methods further comprise delivery of one or more trophic factors into the subject in need of treatment. Trophic factors may include, but are not limited to, IGF-I, GDNF, BDNF, CTNF, VEGF, Colivelin, Xaliproden, Thyrotrophin-releasing hormone and ADNF, and variants thereof.

In one aspect, the AAV particle described herein (e.g., an AAV particle comprising an AAV capsid variant) may be co-administered with AAV particles expressing neurotrophic factors such as AAV-IGF-I (See e.g., Vincent et al., *Neuromolecular medicine*, 2004, 6, 79-85; the contents of which are incorporated herein by reference in their entirety) and AAV-GDNF (See e.g., Wang et al., *J Neurosci.*, 2002, 22, 6920-6928; the contents of which are incorporated herein by reference in their entirety).

In some embodiments, administration of the AAV particles (e.g., an AAV particle comprising an AAV capsid variant) to a subject will modulate, e.g., increase or decrease, the expression of a target protein in a subject and the modulation, e.g., increase or decrease of the presence, level, activity, and/or expression of the target protein will reduce the effects and/or symptoms of a neurological disease/ disorder or a neurodegenerative disorder, a muscular disorder or neuromuscular disorder, and/or a neuro-oncological disorder in a subject.

Definitions

Unless defined otherwise, all technical and scientific terms used herein have the same meaning as commonly understood by one of ordinary skill in the art to which the invention pertains.

Articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The disclosure includes embodiments in which exactly one member of the group is present in, employed in, or otherwise relevant to a given product or process. The disclosure includes embodiments in which more than one, or the entire group members are present in, employed in, or otherwise relevant to a given product or process.

It is also noted that the term "comprising" is intended to be open and permits but does not require the inclusion of additional elements or steps. When the term "comprising" is used herein, the term "consisting of" and "consisting essentially thereof" is thus also encompassed and disclosed.

Where ranges are given, endpoints are included. Furthermore, it is to be understood that unless otherwise indicated or otherwise evident from the context and understanding of one of ordinary skill in the art, values that are expressed as ranges can assume any specific value or subrange within the stated ranges in different embodiments of the disclosure, to the tenth of the unit of the lower limit of the range, unless the context clearly dictates otherwise.

Adeno-associated virus: As used herein, the term "adeno-associated virus" or "AAV" refers to members of the dependovirus genus or a variant, e.g., a functional variant, thereof. In some embodiments, the AAV is wildtype, or naturally occurring. In some embodiments, the AAV is recombinant.

AAV Particle: As used herein, an "AAV particle" refers to a particle or a virion comprising an AAV capsid, e.g., an AAV capsid variant, and a polynucleotide, e.g., a viral genome or a vector genome. In some embodiments, the viral genome of the AAV particle comprises at least one payload region and at least one ITR. In some embodiments, an AAV particle of the disclosure is an AAV particle comprising an AAV variant. In some embodiments, the AAV particle is capable of delivering a nucleic acid, e.g., a payload region, encoding a payload to cells, typically, mammalian, e.g., human, cells. In some embodiments, an AAV particle of the present disclosure may be produced recombinantly. In some embodiments, an AAV particle may be derived from any serotype, described herein or known in the art, including combinations of serotypes (e.g., "pseudotyped" AAV) or from various genomes (e.g., single stranded or self-complementary). In some embodiments, the AAV particle may be replication defective and/or targeted. It is to be understood that reference to the AAV particle of the disclosure also includes pharmaceutical compositions thereof, even if not explicitly recited.

Administering: As used herein, the term "administering" refers to providing a pharmaceutical agent or composition to a subject.

Amelioration: As used herein, the term "amelioration" or "ameliorating" refers to a lessening of severity of at least one indicator of a condition or disease. For example, in the context of neurodegeneration disorder, amelioration includes the reduction of neuron loss.

Amplicon: As used herein, "amplicon" may refer to any piece of RNA or DNA formed as the product of amplification events, e.g. PCR. In some embodiments, full-length capsid amplicons may be used as templates for next generation sequencing (NGS) library generation. Full-length capsid amplicons may be used for cloning into a DNA library for any number of additional rounds of AAV selection as described herein.

Animal: As used herein, the term "animal" refers to any member of the animal kingdom. In some embodiments, "animal" refers to humans at any stage of development. In some embodiments, "animal" refers to non-human animals at any stage of development. In certain embodiments, the non-human animal is a mammal (e.g., a rodent, a mouse, a rat, a rabbit, a monkey, a dog, a cat, a sheep, cattle, a primate, or a pig). In some embodiments, animals include, but are not limited to, mammals, birds, reptiles, amphibians, fish, and worms. In some embodiments, the animal is a transgenic animal, genetically engineered animal, or a clone.

Antisense strand: As used herein, the term "the antisense strand" or "the first strand" or "the guide strand" of a siRNA molecule refers to a strand that is substantially complementary to a section of about 10-50 nucleotides, e.g., about 15-30, 16-25, 18-23 or 19-22 nucleotides of the mRNA of a gene targeted for silencing. The antisense strand or first strand has sequence sufficiently complementary to the desired target mRNA sequence to direct target-specific silencing, e.g., complementarity sufficient to trigger the destruction of the desired target mRNA by the RNAi machinery or process.

Approximately: As used herein, the term "approximately" or "about," as applied to one or more values of interest, refers to a value that is similar to a stated reference value. In certain embodiments, the term "approximately" or "about" refers to a range of values that fall within 25%, 20%, 19%, 18%, 17%, 16%, 15%, 14%, 13%, 12%, 11%, 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value).

Biopanning: As used herein, the term "biopanning" refers to an AAV capsid library selection process comprising administration of an AAV particle with enhanced tissue- and/or cell type-specific transduction to a cell and/or subject; extraction of nucleotides encoded by said AAV particle from said transduced tissue- and/or cell type-specific; and, use of the extracted nucleotides for cloning into a nucleotide library for the generation of AAV particles for subsequent rounds of the same.

Capsid: As used herein, the term "capsid" refers to the exterior, e.g., a protein shell, of a virus particle, e.g., an AAV particle, that is substantially (e.g., >50%, >60%, >70%, >80%, >90%, >95%, >99%, or 100%) protein. In some embodiments, the capsid is an AAV capsid comprising an AAV capsid protein described herein, e.g., a VP1, VP2, and/or VP3 polypeptide. The AAV capsid protein can be a wild-type AAV capsid protein or a variant, e.g., a structural and/or functional variant from a wild-type or a reference capsid protein, referred to herein as an "AAV capsid variant." In some embodiments, the AAV capsid variant described herein has the ability to enclose, e.g., encapsulate, a viral genome and/or is capable of entry into a cell, e.g., a mammalian cell. In some embodiments, the AAV capsid variant described herein may have modified tropism compared to that of a wild-type AAV capsid, e.g., the corresponding wild-type capsid.

Complementary and substantially complementary: As used herein, the term "complementary" refers to the ability of polynucleotides to form base pairs with one another. Base pairs are typically formed by hydrogen bonds between nucleotide units in antiparallel polynucleotide strands. Complementary polynucleotide strands can form base pairs in the Watson-Crick manner (e.g., A to T, A to U, C to G), or in any other manner that allows for the formation of duplexes. As persons skilled in the art are aware, when using RNA as opposed to DNA, uracil rather than thymine is the base that is considered to be complementary to adenine. However, when a U is denoted in the context of the present disclosure, the ability to substitute a T is implied, unless otherwise stated. Perfect complementarity or 100% complementarity refers to the situation in which each nucleotide unit of one polynucleotide strand can form a hydrogen bond with a nucleotide unit of a second polynucleotide strand. Less than perfect complementarity refers to the situation in which some, but not all, nucleotide units of two strands can form hydrogen bond with each other. For example, for two 20-mers, if only two base pairs on each strand can form a hydrogen bond with each other, the polynucleotide strands exhibit 10% complementarity. In the same example, if 18 base pairs on each strand can form hydrogen bonds with each other, the polynucleotide strands exhibit 90% complementarity. The term "complementary" as used herein can encompass fully complementary, partially complementary, or substantially complementary. As used herein, the term "substantially complementary" means that the siRNA has a sequence (e.g., in the antisense strand) which is sufficient to bind the desired target mRNA, and to trigger the RNA silencing of the target mRNA. "Fully complementary", "perfect complementarity", or "100% complementarity" refers to the situation in which each nucleotide unit of one polynucleotide or oligonucleotide strand can base-pair with a nucleotide unit of a second polynucleotide or oligonucleotide strand.

Control Elements: As used herein, "control elements", "regulatory control elements" or "regulatory sequences" refers to promoter regions, polyadenylation signals, transcription termination sequences, upstream regulatory domains, origins of replication, internal ribosome entry sites ("IRES"), enhancers, and the like, which provide for the replication, transcription and translation of a coding sequence in a recipient cell. Not all of these control elements need always be present as long as the selected coding sequence is capable of being replicated, transcribed and/or translated in an appropriate host cell.

Delivery: As used herein, "delivery" refers to the act or manner of delivering an AAV particle, a compound, substance, entity, moiety, cargo or payload.

Element: As used herein, the term "element" refers to a distinct portion of an entity. In some embodiments, an element may be a polynucleotide sequence with a specific purpose, incorporated into a longer polynucleotide sequence.

Encapsulate: As used herein, the term "encapsulate" means to enclose, surround or encase. As an example, a capsid protein, e.g., an AAV capsid variant, often encapsulates a viral genome. In some embodiments, encapsulate within a capsid, e.g., an AAV capsid variant, encompasses 100% coverage by a capsid, as well as less than 100% coverage, e.g., 95%, 90%, 85%, 80%, 70%, 60% or less. For example, gaps or discontinuities may be present in the capsid so long as the viral genome is retained in the capsid, e.g., prior to entry into a cell.

Effective Amount: As used herein, the term "effective amount" of an agent is that amount sufficient to effect beneficial or desired results, for example, clinical results, and, as such, an "effective amount" depends upon the context in which it is being applied. For example, in the context of administering an agent that treats cancer, an effective amount of an agent is, for example, an amount sufficient to achieve treatment, as defined herein, of cancer, as compared to the response obtained without administration of the agent.

Expression: As used herein, "expression" of a nucleic acid sequence refers to one or more of the following events: (1) production of an RNA template from a DNA sequence (e.g., by transcription); (2) processing of an RNA transcript (e.g., by splicing, editing, 5' cap formation, and/or 3' end processing); (3) translation of an RNA into a polypeptide or protein; and (4) post-translational modification of a polypeptide or protein.

Formulation: As used herein, a "formulation" includes at least one AAV particle (active ingredient) and an excipient, and/or an inactive ingredient.

Fragment: A "fragment," as used herein, refers to a portion. For example, an antibody fragment may comprise a CDR, or a heavy chain variable region, or a scFv, etc.

Homology: As used herein, the term "homology" refers to the overall relatedness between polymeric molecules, e.g. between polynucleotide molecules (e.g. DNA molecules and/or RNA molecules) and/or between polypeptide molecules. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical or similar. The term "homologous" necessarily refers to a comparison between at least two sequences (polynucleotide or polypeptide sequences). In accordance with the disclosure, two polynucleotide sequences are considered to be homologous if the polypeptides they encode are at least about 50%, 60%, 70%, 80%, 90%, 95%, or even 99% for at least one stretch of at least about 20 amino acids. In some embodiments, homologous polynucleotide sequences are characterized by the ability to encode a stretch of at least 4-5 uniquely specified amino acids. For polynucleotide sequences less than 60 nucleotides in length, homology is determined by the ability to encode a stretch of at least 4-5 uniquely specified amino acids. In accordance with the disclosure, two protein sequences are considered to be homologous if the proteins are at least about 50%, 60%, 70%, 80%, or 90% identical for at least one stretch of at least about 20 amino acids.

Identity: As used herein, the term "identity" refers to the overall relatedness between polymeric molecules, e.g., between polynucleotide molecules (e.g. DNA molecules and/or RNA molecules) and/or between polypeptide molecules. Calculation of the percent identity of two polynucleotide sequences, for example, can be performed by aligning the two sequences for optimal comparison purposes (e.g., gaps can be introduced in one or both of a first and a second nucleic acid sequences for optimal alignment and non-identical sequences can be disregarded for comparison purposes). In certain embodiments, the length of a sequence aligned for comparison purposes is at least 30%, at least 40%, at least 50%, at least 60%, at least 70%, at least 80%, at least 90%, at least 95%, or 100% of the length of the reference sequence. The nucleotides at corresponding nucleotide positions are then compared. When a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which needs to be introduced for optimal alignment of the two sequences. The comparison of sequences and determination of percent identity between two sequences can be accomplished using a mathematical algorithm. For example, the percent identity between two nucleotide sequences can be determined using methods such as those described in Computational Molecular Biology, Lesk, A. M., ed., Oxford University Press, New York, 1988; Biocomputing: Informatics and Genome Projects, Smith, D. W., ed., Academic Press, New York, 1993; Sequence Analysis in Molecular Biology, von Heinje, G., Academic Press, 1987; Computer Analysis of Sequence Data, Part I, Griffin, A. M., and Griffin, H. G., eds., Humana Press, New Jersey, 1994; and Sequence Analysis Primer, Gribskov, M. and Devereux, J., eds., M Stockton Press, New York, 1991; the contents of each of which are incorporated herein by reference in their entirety. For example, the percent identity between two nucleotide sequences can be determined using the algorithm of Meyers and Miller (CABIOS, 1989, 4:11-17), which has been incorporated into the ALIGN program (version 2.0) using a PAM120 weight residue table, a gap length penalty of 12 and a gap penalty of 4. The percent identity between two nucleotide sequences can, alternatively, be determined using the GAP program in the GCG software package using an NWSgapdna.CMP matrix. Methods commonly employed to determine percent identity between sequences include, but are not limited to those disclosed in Carillo, H., and Lipman, D., SIAM J Applied Math., 48:1073 (1988); incorporated herein by reference. Techniques for determining identity are codified in publicly available computer programs. Exemplary computer software to determine homology between two sequences include, but are not limited to, GCG program package, Devereux, J., et al., *Nucleic Acids Research*, 12(1), 387 (1984)), BLASTP, BLASTN, and FASTA Altschul, S. F. et al., *J. Molec. Biol.*, 215, 403 (1990)).

Inhibit expression of a gene: As used herein, the phrase "inhibit expression of a gene" means to cause a reduction in the amount of an expression product of the gene. The expression product can be an RNA transcribed from the gene (e.g., an mRNA) or a polypeptide translated from an mRNA transcribed from the gene. Typically, a reduction in the level of an mRNA results in a reduction in the level of a polypeptide translated therefrom. The level of expression may be determined using standard techniques for measuring mRNA or protein.

Inverted terminal repeat: As used herein, the term "inverted terminal repeat" or "ITR" refers to a cis-regulatory element for the packaging of polynucleotide sequences into viral capsids.

Isolated: As used herein, the term "isolated" refers to a substance or entity that is altered or removed from the natural state, e.g., altered or removed from at least some of component with which it is associated in the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell. Such polynucleotides could be part of a vector and/or such polynucleotides or polypeptides could be part of a composition, and still be isolated in that such vector or composition is not part of the environment in which it is found in nature. In some embodiments, an isolated nucleic acid is recombinant, e.g., incorporated into a vector.

Library: As used herein, the term "library" refers to a diverse collection of linear polypeptides, polynucleotides, viral particles, or viral vectors. As examples, a library may be a DNA library or an AAV capsid library.

Molecular scaffold: As used herein a "molecular scaffold" is a framework or starting molecule that forms the sequence or structural basis against which to design or make a subsequent molecule.

Neurological disease: As used herein, a "neurological disease" is any disease associated with the central or peripheral nervous system and components thereof (e.g., neurons).

Orthogonal evolution: As used herein, the term "orthogonal evolution" refers to a method wherein AAV particles are administered for a first round of AAV selection as described herein across a set of any number of cell- and/or subject-types that may be from different species and/or strains, and wherein any number of additional, i.e., subsequent, AAV selection rounds are performed either across a set of any number of cell- and/or subject-types that may be from different species and/or strains, or across a set of any number of cell- and/or subject-types that may be from the same species and/or strain.

Open reading frame: As used herein, "open reading frame" or "ORF" refers to a sequence which does not contain a stop codon in a given reading frame.

Particle: As used herein, a "particle" is a virus comprised of at least two components, a protein capsid and a polynucleotide sequence enclosed within the capsid.

Payload region: As used herein, a "payload region" is any nucleic acid sequence (e.g., within the viral genome) which encodes one or more "payloads" of the disclosure. As non-limiting examples, a payload region may be a nucleic acid sequence within the viral genome of an AAV particle, which encodes a payload, wherein the payload is an RNAi agent or a polypeptide. Payloads of the present disclosure may be, but are not limited to, peptides, polypeptides, proteins, antibodies, RNAi agents, etc.

Polypeptide: As used herein, "polypeptide" means a polymer of amino acid residues (natural or unnatural) linked together most often by peptide bonds. The term, as used herein, refers to proteins, polypeptides, and peptides of any size, structure, or function. In some instances, the polypeptide encoded is smaller than about 50 amino acids and the polypeptide is then termed a peptide. If the polypeptide is a peptide, it will be at least about 2, 3, 4, or at least 5 amino acid residues long. Thus, polypeptides include gene products, naturally occurring polypeptides, synthetic polypeptides, homologs, orthologs, paralogs, fragments and other equivalents, variants, and analogs of the foregoing. A polypeptide may be a single molecule or may be a multi-molecular complex such as a dimer, trimer or tetramer. They may also comprise single chain or multichain polypeptides and may be associated or linked. The term polypeptide may also apply to amino acid polymers in which one or more amino acid residues are an artificial chemical analogue of a corresponding naturally occurring amino acid.

Polypeptide variant: The term "polypeptide variant" refers to molecules which differ in their amino acid sequence from a native or reference sequence. The amino acid sequence variants may possess substitutions, deletions, and/ or insertions at certain positions within the amino acid sequence, as compared to a native or reference sequence. In some embodiments, a variant comprises a sequence having at least about 50%, at least about 80%, or at least about 90%, identical (homologous) to a native or a reference sequence.

Peptide: As used herein, "peptide" is less than or equal to 50 amino acids long, e.g., about 5, 10, 15, 20, 25, 30, 35, 40, 45, or 50 amino acids long.

Pharmaceutically acceptable: The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

Preventing: As used herein, the term "preventing" or "prevention" refers to partially or completely delaying onset of an infection, disease, disorder and/or condition; partially or completely delaying onset of one or more symptoms, features, or clinical manifestations of a particular infection, disease, disorder, and/or condition; partially or completely delaying onset of one or more symptoms, features, or manifestations of a particular infection, disease, disorder, and/or condition; partially or completely delaying progression from an infection, a particular disease, disorder and/or condition; and/or decreasing the risk of developing pathology associated with the infection, the disease, disorder, and/or condition.

Prophylactic: As used herein, "prophylactic" refers to a therapeutic or course of action used to prevent the spread of disease.

Prophylaxis: As used herein, a "prophylaxis" refers to a measure taken to maintain health and prevent the spread of disease.

Region: As used herein, the term "region" refers to a zone or general area. In some embodiments, when referring to a protein or protein module, a region may comprise a linear sequence of amino acids along the protein or protein module or may comprise a three-dimensional area, an epitope and/or a cluster of epitopes. In some embodiments, regions comprise terminal regions. As used herein, the term "terminal region" refers to regions located at the ends or termini of a given agent. When referring to proteins, terminal regions may comprise N- and/or C-termini.

In some embodiments, when referring to a polynucleotide, a region may comprise a linear sequence of nucleic acids along the polynucleotide or may comprise a three-dimensional area, secondary structure, or tertiary structure. In some embodiments, regions comprise terminal regions. As used herein, the term "terminal region" refers to regions located at the ends or termini of a given agent. When referring to polynucleotides, terminal regions may comprise 5' and/or 3' termini.

RNA or RNA molecule: As used herein, the term "RNA" or "RNA molecule" or "ribonucleic acid molecule" refers to a polymer of ribonucleotides; the term "DNA" or "DNA molecule" or "deoxyribonucleic acid molecule" refers to a polymer of deoxyribonucleotides. DNA and RNA can be synthesized naturally, e.g., by DNA replication and transcription of DNA, respectively; or be chemically synthesized. DNA and RNA can be single-stranded (i.e., ssRNA or ssDNA, respectively) or multi-stranded (e.g., double stranded, i.e., dsRNA and dsDNA, respectively). The term "mRNA" or "messenger RNA", as used herein, refers to a single stranded RNA that encodes the amino acid sequence of one or more polypeptide chains.

RNA interfering or RNAi: As used herein, the term "RNA interfering" or "RNAi" refers to a sequence specific regulatory mechanism mediated by RNA molecules which results in the inhibition or interfering or "silencing" of the expression of a corresponding protein-coding gene. RNAi has been observed in many types of organisms, including plants, animals and fungi. RNAi occurs in cells naturally to remove foreign RNAs (e.g., viral RNAs). Natural RNAi proceeds via fragments cleaved from free dsRNA which direct the degradative mechanism to other similar RNA sequences. RNAi is controlled by the RNA-induced silencing complex (RISC) and is initiated by short/small dsRNA molecules in cell cytoplasm, where they interact with the catalytic RISC component argonaute. The dsRNA molecules can be introduced into cells exogenously. Exogenous dsRNA initiates RNAi by activating the ribonuclease protein Dicer, which binds and cleaves dsRNAs to produce double-stranded fragments of 21-25 base pairs with a few unpaired overhang bases on each end. These short double stranded fragments are called small interfering RNAs (siRNAs).

RNAi agent: As used herein, the term "RNAi agent" refers to an RNA molecule, or its derivative, that can induce inhibition, interfering, or "silencing" of the expression of a target gene and/or its protein product. An RNAi agent may knock-out (virtually eliminate or eliminate) expression, or knock-down (lessen or decrease) expression. The RNAi agent may be, but is not limited to, dsRNA, siRNA, shRNA, pre-miRNA, pri-miRNA, miRNA, stRNA, lncRNA, piRNA, or snoRNA.

miR binding site: As used herein, a "miR binding site" comprises a nucleic acid sequence (whether RNA or DNA, e.g., differ by "U" of RNA or "T" in DNA) that is capable of binding, or binds, in whole or in part to a microRNA (miR) through complete or partial hybridization. Typically, such binding occurs between the miR and the miR binding site in the reverse complement orientation. In some embodiments, the miR binding site is transcribed from the AAV vector genome encoding the miR binding site.

In some embodiments, a miR binding site may be encoded or transcribed in series. Such a "miR binding site series" or "miR BSs" may include two or more miR binding sites having the same or different nucleic acid sequence.

Spacer: As used here, a "spacer" is generally any selected nucleic acid sequence of, e.g., 1, 2, 3, 4, 5, 6, 7, 8, 9, or 10 nucleotides in length, which is located between two or more consecutive miR binding site sequences. Spacers may also be more than 10 nucleotides in length, e.g., 20, 30, 40, or 50 or more than 50 nucleotides.

Sample: As used herein, the term "sample" or "biological sample" refers to a subset of its tissues, cells, nucleic acids, or component parts (e.g. body fluids, including but not limited to blood, serum, mucus, lymphatic fluid, synovial fluid, cerebrospinal fluid, saliva, amniotic fluid, amniotic cord blood, urine, vaginal fluid and semen).

Self-complementary viral particle: As used herein, a "self-complementary viral particle" is a particle comprised of at least two components, a protein capsid and a self-complementary viral genome enclosed within the capsid.

Sense Strand: As used herein, the term "the sense strand" or "the second strand" or "the passenger strand" of a siRNA molecule refers to a strand that is complementary to the antisense strand or first strand. The antisense and sense strands of a siRNA molecule are hybridized to form a duplex structure. As used herein, a "siRNA duplex" includes a siRNA strand having sufficient complementarity to a section of about 10-50 nucleotides of the mRNA of the gene targeted for silencing and a siRNA strand having sufficient complementarity to form a duplex with the other siRNA strand.

Similarity: As used herein, the term "similarity" refers to the overall relatedness between polymeric molecules, e.g. between polynucleotide molecules (e.g. DNA molecules and/or RNA molecules) and/or between polypeptide molecules. Calculation of percent similarity of polymeric molecules to one another can be performed in the same manner as a calculation of percent identity, except that calculation of percent similarity takes into account conservative substitutions as is understood in the art.

Short interfering RNA or siRNA: As used herein, the terms "short interfering RNA," "small interfering RNA" or "siRNA" refer to an RNA molecule (or RNA analog) comprising between about 5-60 nucleotides (or nucleotide analogs) which is capable of directing or mediating RNAi. Preferably, a siRNA molecule comprises between about 15-30 nucleotides or nucleotide analogs, such as between about 16-25 nucleotides (or nucleotide analogs), between about 18-23 nucleotides (or nucleotide analogs), between about 19-22 nucleotides (or nucleotide analogs) (e.g., 19, 20, 21 or 22 nucleotides or nucleotide analogs), between about 19-25 nucleotides (or nucleotide analogs), and between about 19-24 nucleotides (or nucleotide analogs). The term "short" siRNA refers to a siRNA comprising 5-23 nucleotides, preferably 21 nucleotides (or nucleotide analogs), for example, 19, 20, 21 or 22 nucleotides. The term "long" siRNA refers to a siRNA comprising 24-60 nucleotides, preferably about 24-25 nucleotides, for example, 23, 24, 25 or 26 nucleotides. Short siRNAs may, in some instances, include fewer than 19 nucleotides, e.g., 16, 17 or 18 nucleotides, or as few as 5 nucleotides, provided that the shorter siRNA retains the ability to mediate RNAi. Likewise, long siRNAs may, in some instances, include more than 26 nucleotides, e.g., 27, 28, 29, 30, 35, 40, 45, 50, 55, or even 60 nucleotides, provided that the longer siRNA retains the ability to mediate RNAi or translational repression absent further processing, e.g., enzymatic processing, to a short siRNA. siRNAs can be single stranded RNA molecules (ss-siRNAs) or double stranded RNA molecules (ds-siRNAs) comprising a sense strand and an antisense strand which hybridized to form a duplex structure called an siRNA duplex.

Subject: As used herein, the term "subject" or "patient" refers to any organism to which a composition in accordance with the disclosure may be administered, e.g., for experimental, diagnostic, prophylactic, and/or therapeutic purposes. Typical subjects include animals (e.g., mammals such as mice, rats, rabbits, non-human primates, and humans) and/or plants.

Substantially: As used herein, the term "substantially" refers to the qualitative condition of exhibiting total or near-total extent or degree of a characteristic or property of interest. One of ordinary skill in the biological arts will understand that biological and chemical phenomena rarely, if ever, go to completion and/or proceed to completeness or achieve or avoid an absolute result. The term "substantially" is therefore used herein to capture the potential lack of completeness inherent in many biological and chemical phenomena.

Target Cells: As used herein, "target cells" or "target tissue" refers to any one or more cells of interest. The cells may be found in vitro, in vivo, in situ or in the tissue or organ of an organism. The organism may be an animal, preferably a mammal, more preferably a human and most preferably a patient.

Therapeutic Agent: The term "therapeutic agent" refers to any agent that, when administered to a subject, has a therapeutic, diagnostic, and/or prophylactic effect and/or elicits a desired biological and/or pharmacological effect.

Therapeutically effective amount: As used herein, the term "therapeutically effective amount" means an amount of an agent to be delivered (e.g., nucleic acid, drug, therapeutic agent, diagnostic agent, prophylactic agent, etc.) that is sufficient, when administered to a subject suffering from or susceptible to an infection, disease, disorder, and/or condition, to treat, improve symptoms of, diagnose, prevent, and/or delay the onset of the infection, disease, disorder, and/or condition. In some embodiments, a therapeutically effective amount is provided in a single dose.

Therapeutically effective outcome: As used herein, the term "therapeutically effective outcome" means an outcome that is sufficient in a subject suffering from or susceptible to an infection, disease, disorder, and/or condition, to treat, improve symptoms of, diagnose, prevent, and/or delay the onset of the infection, disease, disorder, and/or condition.

Treating: As used herein, the term "treating" refers to partially or completely alleviating, ameliorating, improving, relieving, delaying onset of, inhibiting progression of, reducing severity of, and/or reducing incidence of one or more symptoms or features of a particular infection, disease, disorder, and/or condition. For example, "treating" cancer may refer to inhibiting survival, growth, and/or spread of a tumor. Treatment may be administered to a subject who does not exhibit signs of a disease, disorder, and/or condition and/or to a subject who exhibits only early signs of a disease, disorder, and/or condition for the purpose of decreasing the risk of developing pathology associated with the disease, disorder, and/or condition.

Conservative amino acid substitution: As used herein, a "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

Variant: As used herein, the term "variant" refers to a polypeptide or polynucleotide that has an amino acid or a nucleotide sequence that is substantially identical, e.g., having at least 70%, 75%, 80%, 85%, 90%, 95% or 99% sequence identity to a reference sequence. In some embodiments, the variant is a functional variant.

Functional Variant: As used herein, the term "functional variant" refers to a polypeptide variant or a polynucleotide variant that has at least one activity of the reference sequence.

Insertional Variant: "Insertional variants" when referring to polypeptides are those with one or more amino acids inserted, e.g., immediately adjacent or subsequent, to a position in an amino acid sequence. "Immediately adjacent" or "immediately subsequent" to an amino acid means connected to either the alpha-carboxy or alpha-amino functional group of the amino acid.

Deletional Variant: "Deletional variants" when referring to polypeptides, are those with one or more amino acids in deleted from a reference protein.

Vector: As used herein, the term "vector" refers to any molecule or moiety which transports, transduces or otherwise acts as a carrier of a heterologous molecule. In some embodiments, vectors may be plasmids. In some embodiments, vectors may be viruses. An AAV particle is an example of a vector. Vectors of the present disclosure may be produced recombinantly and may be based on and/or may comprise adeno-associated virus (AAV) parent or reference sequences. The heterologous molecule may be a polynucleotide and/or a polypeptide.

Viral Genome: As used herein, the terms "viral genome" or "vector genome" refer to the nucleic acid sequence(s) encapsulated in an AAV particle. A viral genome comprises a nucleic acid sequence with at least one payload region encoding a payload and at least one ITR.

Equivalents and Scope

The disclosures of each and every patent, patent application, and publication cited herein are hereby incorporated herein by reference in their entirety. While this invention has been disclosed with reference to certain embodiments, it is apparent that further embodiments and variations of this invention may be devised by others skilled in the art without departing from the true spirit and scope of the invention. The appended claims are intended to be construed to include all such embodiments and equivalent variations.

The present disclosure is further illustrated by the following non-limiting examples.

EXAMPLES

Example 1. High-Throughput Screen of TRACER AAV Library in NHP and Mice

A TRACER based method as described in WO2020072683, WO 2021/202651, and WO2021230987, the contents of which are herein incorporated by reference in their entirety, was used to generate the AAV capsid variants described herein. An orthogonal evolution approach was combined with a high throughput screening by NGS. Briefly, the library of AAV capsid variants was generated using a sliding window approach, where 6 amino acid sequences were inserted into 8 different positions across loop IV of AAV9, including immediately subsequent to positions 453, 454, 455, 456, 457, 458, 459, and 460, relative to a reference sequence numbered according to SEQ ID NO: 138. The initial library was passed twice through non-human primates (NHP, 2-4 years of age). After the second passage (e.g., 28 days post injection into two NHPs), RNA was extracted from six brain regions. Following RNA recovery and RT-PCR amplification, a systematic NGS enrichment analysis was performed to calculate fold enrichment relative to an AAV9 wild-type control. Following these two passages, approximately 21195 variants were identified with an average fold change greater than wild-type. Of the 21195 variants, 1558 demonstrated a fold-change of greater than 6 compared to wild-type and were detected across all brain regions investigated. Of these 1558, approximately 1470 variants were selected for constructing a synthetic library and a third passage through two NHPs. Within the 1470 variants selected for further characterization and investigation, there was a relatively even distribution for each insertion position of the sliding window used to generate the initial library.

After creation of the synthetic library with the subselected variants, the synthetic library was screened (passage 3) in two NHPs (2-4 years of age) and two strains of mice, BALB/c (n=3, 6-8 weeks of age) and C57B1/6 mice (n=3, 6-8 weeks of age), in a first cross-species evolution screen. The animals were injected intravenously with the synthetic library. After a period in vivo, (e.g., 28-days) RNA was extracted from nervous tissue, e.g., brain, spinal cord, and DRG of the NHPs and the brains of mice. Following RNA recovery and RT-PCR amplification, a systematic NGS enrichment analysis was performed, and the peptides comprised within the variants were identified and the capsid enrichment ratio for each variant compared to the wild-type AAV9 control was calculated (fold enrichment relative to wild-type AAV9) (Table 9). Values above 1 indicate an increase in expression relative to AAV9. All animals were dosed intravenously at 2-3 VG/kg across the screen.

As shown in Table 9, approximately 700 variants demonstrated an increase in expression relative to AAV9, and several variants demonstrated a greater than 10-fold enrichment relative to AAV9 in the brain of NHPs. Further, the variants demonstrating the greatest fold enrichment in the brain also demonstrated the greatest fold enrichment in the spinal cord relative to AAV9 in NHPs. These variants also demonstrated de-targeting in the DRG (data not shown). For instance, the variant comprising GSGSPHSKAQNQQT (SEQ ID NO: 200) demonstrated a 76.6 fold enrichment in the brain, a 29.4 fold enrichment in the spinal cord, and 0.4 fold enrichment in the DRG of NHPs relative to AAV9; and GHDSPHKSGQNQQT (SEQ ID NO: 201) demonstrated a 62.6 fold enrichment in the brain, a 15.6 fold enrichment in the spinal cord, and 0.0 fold enrichment in the DRG of NHPs relative to AAV9. Also, across the peptides comprised within the AAV capsid variants with the greatest fold-enrichment in the NHP brain relative wild-type AAV9, it was observed that each of these peptides comprised an SPH motif in the same position (e.g., immediately subsequent to position 455, relative to a reference sequence numbered according to the amino acid sequence of SEQ ID NO: 138), regardless of the insertion position within the variant capsid, as well as a positive amino acid (e.g., K or R) in one of the next three residues subsequent to the SPH motif.

Those variants with the greatest fold enrichment in the brains of NHPs also had the greatest fold enrichment in the brains of both mouse species. Also, when comparing the fold enrichment relative to wild-type for each variant between the two species of mice investigated (C571B1/6 and BALB/c mice), they were highly correlated ($R^2$=0.8591).

TABLE 9

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGSPHSKAQNQQT | 200 | 73.615 | 29.402 | 25.293 | 41.304 |
| GHDSPHKSGQNQQT | 201 | 62.612 | 15.641 | 63.993 | 49.760 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGSPHARMQNQQT | 202 | 56.138 | 22.690 | 7.795 | 4.164 |
| GSGSPHVKSQNQQT | 203 | 37.551 | 13.649 | 8.069 | 15.861 |
| GQDSPHKSGQNQQT | 204 | 24.569 | 3.548 | 57.344 | 42.615 |
| GSGSPHASRQNQQT | 205 | 18.265 | 7.804 | 28.028 | 36.577 |
| GSGSPHASRQNKQT | 206 | 17.520 | 35.029 | 13.096 | 18.114 |
| GSGSPHVKIQNQQT | 207 | 16.854 | 9.068 | 2.173 | 2.227 |
| GSGSPHSKAKNQQT | 208 | 14.458 | 0.049 | 21.494 | 23.556 |
| GSGSPHKKNQNQQT | 209 | 12.991 | 0.379 | 25.958 | 7.415 |
| GSGSPHVRMQNQQT | 210 | 11.574 | 6.764 | 9.121 | 10.076 |
| GSGSPHASRQKQQT | 211 | 11.417 | 0.005 | 7.413 | 12.400 |
| GHSSPHRSGQNQQT | 212 | 10.357 | 1.887 | 23.197 | 25.442 |
| GMRTYHLSGQNQQT | 213 | 9.241 | 1.939 | 2.033 | 1.586 |
| GSGSPHTRGQNQQT | 214 | 7.092 | 3.815 | 10.801 | 6.240 |
| GSGIIPVSSQNQQT | 215 | 6.352 | 0.000 | 0.642 | 0.253 |
| GSEYGHKSGQNQQT | 216 | 6.308 | 2.750 | 5.198 | 5.332 |
| GRGQNVSSVHRQQT | 217 | 5.404 | 0.000 | 1.206 | 0.691 |
| GSSHRFYGGQNQQT | 218 | 4.732 | 0.000 | 0.787 | 0.110 |
| GYFVAAWSGQNQQT | 219 | 4.488 | 0.000 | 0.071 | 0.175 |
| GSVLHSHAAQNQQT | 220 | 4.150 | 6.448 | 0.675 | 0.423 |
| GSGDLVVSTQNQQT | 221 | 3.874 | 1.177 | 0.411 | 0.273 |
| GSYGMAASGQNQQT | 222 | 3.817 | 10.052 | 1.274 | 0.829 |
| GLNHFGASGQNQQT | 223 | 3.802 | 3.188 | 0.774 | 0.579 |
| GSTGSHSAGQNQHT | 224 | 3.717 | 0.285 | 1.190 | 0.850 |
| GLAGHTVSGQNQQT | 225 | 3.632 | 0.229 | 0.972 | 0.202 |
| GIILGASSGQNQQT | 226 | 3.630 | 4.868 | 1.378 | 0.865 |
| GSGVSTYNIQNQQT | 227 | 3.609 | 2.912 | 0.769 | 0.520 |
| GSLVSVQTGQNQQT | 228 | 3.534 | 6.043 | 0.903 | 0.469 |
| GQSSPHRSGQNQQT | 229 | 3.496 | 2.142 | 12.352 | 19.366 |
| GREYGHKSGQNQQT | 230 | 3.453 | 0.000 | 1.422 | 0.959 |
| GHTLTLSSGQNQQT | 231 | 3.405 | 5.648 | 0.648 | 0.606 |
| GSITLIPSGQNQQT | 232 | 3.361 | 3.917 | 0.326 | 0.435 |
| GSNGFTALGQNQQT | 233 | 3.361 | 2.663 | 0.830 | 0.332 |
| GSGHSSHSVQNQQT | 234 | 3.339 | 3.318 | 0.942 | 0.424 |
| GSGIPQRSGKNQQT | 235 | 3.331 | 0.000 | 1.418 | 1.685 |
| GSGDTLHMLQNQQT | 236 | 3.317 | 1.174 | 0.393 | 0.482 |
| GERHTVLSGQNQQT | 237 | 3.289 | 3.008 | 1.027 | 0.607 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGMPQSHIQNQQT | 238 | 3.289 | 11.609 | 0.514 | 0.334 |
| GSGQLSGIGGNQQT | 239 | 3.266 | 0.287 | 0.993 | 0.626 |
| GSGQNRKPASFAQT | 240 | 3.204 | 0.000 | 0.892 | 1.061 |
| GSGSVSQLGQNQQT | 241 | 3.184 | 2.307 | 0.596 | 0.375 |
| GSDFLGTHGQNQQT | 242 | 3.171 | 0.348 | 1.038 | 0.750 |
| GQIVQNPSGQNQQT | 243 | 3.133 | 0.406 | 1.446 | 0.635 |
| GSGTQIPSQQNQQT | 244 | 3.112 | 1.224 | 0.470 | 0.151 |
| GSGQNQQSAREGLT | 245 | 3.111 | 5.632 | 1.221 | 1.104 |
| GSGLGMSTGQNQQT | 246 | 3.110 | 5.499 | 0.458 | 0.660 |
| GSGLPVLSGQNQQT | 247 | 3.100 | 4.149 | 0.631 | 0.210 |
| GSGHSIRTDQNQQT | 248 | 3.074 | 15.600 | 0.229 | 0.148 |
| GSGQSVQTVVNQQT | 249 | 3.057 | 5.441 | 0.582 | 0.240 |
| GSGQNRAQSRFQQT | 250 | 3.043 | 0.000 | 0.619 | 1.788 |
| GGGDLGRSSQNQQT | 251 | 3.036 | 4.830 | 0.916 | 0.539 |
| GGGTKMDSGQNQQT | 252 | 3.034 | 0.000 | 0.733 | 0.297 |
| GSGSPHPSRQNQQT | 253 | 3.017 | 1.993 | 1.869 | 0.975 |
| GSGQFTNAGMNQQT | 254 | 2.969 | 0.936 | 0.565 | 0.418 |
| GGRNGHTVGQNQQT | 255 | 2.965 | 3.732 | 1.105 | 1.003 |
| GSGFGPQTGQNQQT | 256 | 2.964 | 2.861 | 1.280 | 0.849 |
| GRTDSHTSGQNQQT | 257 | 2.913 | 1.510 | 1.299 | 0.704 |
| GYEVLGSSGQNQQT | 258 | 2.891 | 0.000 | 2.459 | 0.319 |
| GSVHLSVTGQNQQT | 259 | 2.882 | 1.157 | 0.741 | 0.282 |
| GFMSYKGSGQNQQT | 260 | 2.865 | 0.209 | 1.808 | 0.569 |
| GNIAGSVSGQNQQT | 261 | 2.849 | 1.187 | 0.446 | 0.257 |
| GSGSHRDVSQNQQT | 262 | 2.843 | 4.022 | 0.626 | 0.550 |
| GGLGSMSSGQNQQT | 263 | 2.812 | 1.405 | 1.802 | 0.822 |
| GSGHLPQSAQNQQT | 264 | 2.803 | 7.828 | 0.826 | 0.496 |
| GGVLVGGSGQNQQT | 265 | 2.778 | 0.178 | 1.527 | 0.688 |
| GTHPYTSSGQNQQT | 266 | 2.775 | 1.684 | 0.758 | 0.471 |
| GSGQNQQLKENRST | 267 | 2.765 | 0.062 | 1.149 | 1.118 |
| GSGQNQQTSPHNHT | 268 | 2.761 | 3.132 | 1.524 | 0.845 |
| GSGTLYPQSQNQQT | 269 | 2.761 | 5.558 | 0.324 | 0.160 |
| GSGQNQQSNWITKT | 270 | 2.711 | 0.000 | 0.540 | 0.634 |
| GSGYTSLFLQNQQT | 271 | 2.710 | 0.010 | 0.490 | 1.044 |
| GSGVMTHVLQNQQT | 272 | 2.692 | 0.347 | 0.370 | 0.533 |
| GSVSDVRAGQNQQT | 273 | 2.661 | 1.647 | 0.267 | 0.747 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQSHMATLNQQT | 274 | 2.657 | 0.724 | 1.173 | 0.504 |
| GSGLSVHLAQNQQT | 275 | 2.657 | 1.234 | 0.806 | 0.508 |
| GSGLSHATQQNQQT | 276 | 2.640 | 7.819 | 1.111 | 0.638 |
| GSGLSVQSGQNQQT | 277 | 2.637 | 2.929 | 1.695 | 1.005 |
| GSGHMTYREKNQQT | 278 | 2.633 | 5.267 | 1.257 | 0.540 |
| GSKGVPTPGQNQQT | 279 | 2.625 | 1.292 | 1.452 | 0.459 |
| GSGLLPLSSQNQQT | 280 | 2.612 | 1.130 | 0.501 | 0.293 |
| GNGLYAVSGQNQQT | 281 | 2.611 | 9.148 | 0.322 | 0.213 |
| GFNGSPSSGQNQQT | 282 | 2.609 | 12.197 | 2.338 | 0.924 |
| GSGQIRHSDQNQQT | 283 | 2.600 | 12.884 | 1.170 | 0.320 |
| GGQVAPSSGQNQQT | 284 | 2.581 | 2.427 | 1.433 | 0.709 |
| GSFSMHTHGQNQQT | 285 | 2.535 | 0.118 | 1.027 | 0.693 |
| GSGQNQQVIQGSNT | 286 | 2.521 | 8.778 | 0.935 | 0.810 |
| GRVLHSHAGQNQQT | 287 | 2.513 | 0.826 | 1.294 | 0.908 |
| GSGQNQQTSLQDQT | 288 | 2.505 | 0.500 | 0.315 | 0.968 |
| GSGLGRAPVQNQQT | 289 | 2.503 | 2.214 | 0.841 | 0.383 |
| GNGFSSASGQNQQT | 290 | 2.493 | 0.772 | 0.240 | 0.182 |
| GSGQMASRESNQQT | 291 | 2.492 | 0.300 | 0.341 | 0.288 |
| GPGLPNHSGQNQQT | 292 | 2.486 | 1.992 | 1.197 | 0.659 |
| GNIQWQGSGQNQQT | 293 | 2.468 | 6.266 | 1.182 | 0.837 |
| GMSAHMSSGQNQQT | 294 | 2.456 | 5.255 | 1.310 | 0.947 |
| GHSFVNRSGQNQQT | 295 | 2.447 | 11.148 | 1.305 | 0.756 |
| GRAVMDHSGQNQQT | 296 | 2.408 | 3.209 | 0.728 | 0.283 |
| GALTVMQSGQNQQT | 297 | 2.381 | 0.430 | 0.246 | 0.199 |
| GSGQRSPVLPNQQT | 298 | 2.369 | 6.230 | 0.434 | 0.526 |
| GSGQNGHLSLKQQT | 299 | 2.362 | 1.896 | 0.718 | 0.270 |
| GSLPRGTSDQNQQT | 300 | 2.362 | 0.000 | 0.453 | 0.495 |
| GVAGSLVSGQNQQT | 301 | 2.358 | 7.670 | 1.321 | 1.160 |
| GRGGIPQSGQNQQT | 302 | 2.352 | 8.683 | 1.639 | 1.181 |
| GSGQYASSIPNQQT | 303 | 2.346 | 3.321 | 1.022 | 0.489 |
| GTDFGRQSSQNQQT | 304 | 2.346 | 3.196 | 1.021 | 0.797 |
| GIFMQTPSGQNQQT | 305 | 2.344 | 6.198 | 0.938 | 0.252 |
| GSGQNQQTRLVDLT | 306 | 2.342 | 9.348 | 1.268 | 0.490 |
| GTREMPLSGQNQQT | 307 | 2.339 | 2.830 | 1.436 | 0.538 |
| GSRLVHVHGQNQQT | 308 | 2.334 | 1.174 | 1.277 | 0.934 |
| GSGRLVPNGPNQQT | 309 | 2.314 | 3.925 | 0.639 | 0.411 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGYLRESPQNQQT | 310 | 2.311 | 0.878 | 0.331 | 0.677 |
| GARIQNASGQKQQT | 311 | 2.300 | 2.103 | 1.220 | 1.039 |
| GLSNPMPSGQNQQT | 312 | 2.280 | 6.033 | 1.190 | 0.829 |
| GSTVQDTRGQNQQT | 313 | 2.270 | 4.979 | 0.576 | 0.473 |
| GPFGMPSSGQNQQT | 314 | 2.260 | 2.700 | 0.727 | 0.560 |
| GSGQNHGVLSNQQT | 315 | 2.254 | 1.603 | 1.113 | 0.701 |
| GSGYSMSQAQNQQT | 316 | 2.250 | 4.479 | 0.519 | 0.329 |
| GSGMLTHTLQNQQT | 317 | 2.246 | 2.272 | 0.496 | 0.199 |
| GRGSPHASRQNQQT | 318 | 2.241 | 0.000 | 5.050 | 5.856 |
| GLSWPSTSGQNQQT | 319 | 2.238 | 0.000 | 0.910 | 0.610 |
| GNSMERTSGQNQQT | 320 | 2.221 | 4.177 | 1.047 | 0.935 |
| GSGMSPSTLQNQQT | 321 | 2.216 | 3.053 | 0.318 | 0.153 |
| GSGHGQVLSQNQQT | 322 | 2.213 | 12.133 | 1.880 | 0.661 |
| GRGQIYSTGGNQQT | 323 | 2.210 | 11.629 | 1.329 | 0.743 |
| GVVAAHNSGQNQQT | 324 | 2.202 | 1.301 | 1.196 | 1.336 |
| GDSSLRHSGQNQQT | 325 | 2.194 | 0.000 | 0.662 | 0.412 |
| GSLVSQGAGQNQQT | 326 | 2.188 | 4.414 | 1.436 | 1.246 |
| GSLLQAHSGQNQQT | 327 | 2.182 | 1.008 | 0.575 | 0.748 |
| GSGHIYVGIQNQQT | 328 | 2.178 | 6.428 | 0.989 | 0.337 |
| GHHTTVQSGQNQQT | 329 | 2.177 | 6.245 | 0.851 | 0.755 |
| GSRQSKRNELNQQT | 330 | 2.177 | 0.000 | 1.325 | 0.232 |
| GSGQNQQHVSSPRT | 331 | 2.176 | 1.279 | 1.847 | 0.938 |
| GSSKELLWGQNQQT | 332 | 2.163 | 0.000 | 0.506 | 0.883 |
| GSLSTPSSGQNQQT | 333 | 2.159 | 1.279 | 1.094 | 0.669 |
| GSIGYAGQGQNQQT | 334 | 2.157 | 4.951 | 1.604 | 0.712 |
| GSGQNQRVSNSQQT | 335 | 2.146 | 0.492 | 1.086 | 0.985 |
| GSGYASHVQQNQQT | 336 | 2.146 | 3.038 | 1.157 | 0.758 |
| GSGEYSRSGQNQQT | 337 | 2.145 | 0.745 | 0.617 | 0.205 |
| GSVSTHSSGQNQQT | 338 | 2.145 | 3.446 | 1.198 | 0.918 |
| GSGQNQHSLGNYQT | 339 | 2.143 | 1.896 | 1.077 | 0.606 |
| GSGGLDTRGQNQQT | 340 | 2.139 | 6.216 | 0.236 | 0.197 |
| GNILHATSGQNQQT | 341 | 2.136 | 0.125 | 1.159 | 0.424 |
| GSGQSYTMTQNQQT | 342 | 2.136 | 6.755 | 0.297 | 0.231 |
| GSGQNQHSAPNSQT | 343 | 2.134 | 4.143 | 1.187 | 0.731 |
| GSGQNQQTMDHNRT | 344 | 2.130 | 4.944 | 0.642 | 0.440 |
| GSNGGVGTGQNQQT | 345 | 2.130 | 0.788 | 1.191 | 1.087 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GAGSIIPSGQNQQT | 346 | 2.129 | 7.164 | 0.595 | 0.249 |
| GSGQTHGGQHNQQT | 347 | 2.125 | 12.251 | 1.448 | 1.098 |
| GSNLSFQSGQNQQT | 348 | 2.122 | 5.853 | 1.087 | 0.719 |
| GATLQVHSGQNQQT | 349 | 2.122 | 2.219 | 0.623 | 0.545 |
| GSGFNQRSEQNQQT | 350 | 2.121 | 4.491 | 1.770 | 0.758 |
| GSGSLRDFDQNQQT | 351 | 2.120 | 6.846 | 0.586 | 0.272 |
| GSGDSITGKQNQQT | 352 | 2.112 | 1.295 | 0.793 | 0.306 |
| GSGQDRNIVQNQQT | 353 | 2.112 | 0.229 | 0.454 | 0.632 |
| GSGLSHSHQQNQQT | 354 | 2.109 | 5.852 | 1.256 | 0.592 |
| GSGQNQQTGMSSVK | 355 | 2.109 | 4.544 | 1.451 | 0.679 |
| GSVTHGISGQNQQT | 356 | 2.105 | 4.542 | 1.135 | 0.789 |
| GVVAHQPSGQNQQT | 357 | 2.103 | 0.152 | 0.910 | 2.267 |
| GSGPILGQLQNQQT | 358 | 2.097 | 2.058 | 0.470 | 0.123 |
| GSGHVPNSGLNQQT | 359 | 2.091 | 0.653 | 1.636 | 1.154 |
| GDAGVRSSGQNQQT | 360 | 2.068 | 3.918 | 1.033 | 1.193 |
| GSGSQLMSLQNQQT | 361 | 2.065 | 3.559 | 0.563 | 0.172 |
| GSGLDYSQRQNQQT | 362 | 2.056 | 0.837 | 0.484 | 0.217 |
| GSGQSSGRLINKQT | 363 | 2.055 | 28.135 | 0.543 | 0.277 |
| GSSVSPSSGQNQQT | 364 | 2.054 | 0.579 | 1.064 | 0.787 |
| GSGQVVGLSGNQQT | 365 | 2.052 | 7.212 | 0.785 | 0.881 |
| GSNMGVPLGQNQQT | 366 | 2.049 | 2.448 | 0.334 | 0.420 |
| GSFYPSSTGQNQQT | 367 | 2.047 | 2.374 | 0.420 | 0.277 |
| GSGQNQQTRLTDLT | 368 | 2.046 | 8.470 | 0.910 | 0.776 |
| GPTNGRSSGQNQQT | 369 | 2.034 | 8.903 | 0.936 | 1.308 |
| GSGLLHGKLQNQQT | 370 | 2.032 | 2.521 | 1.068 | 0.917 |
| GANMGHVSGQNQQT | 371 | 2.020 | 0.810 | 1.302 | 1.138 |
| GSGQNQQSGRGDLT | 372 | 2.019 | 6.919 | 0.524 | 1.152 |
| GSHGHYASGQKQQT | 373 | 2.016 | 0.000 | 0.895 | 0.685 |
| GSGDLRISPQNQQT | 374 | 2.012 | 16.207 | 0.620 | 0.237 |
| GSGMPVILGQNQQT | 375 | 2.005 | 0.150 | 0.840 | 0.287 |
| GRGVITSSGQNHQT | 376 | 2.004 | 0.864 | 1.656 | 0.669 |
| GSGHSVSGPQNQQT | 377 | 1.993 | 6.259 | 1.370 | 0.619 |
| GSRNGHTVGRNQQT | 378 | 1.993 | 0.000 | 1.162 | 0.367 |
| GAGVHMVSGQNQQT | 379 | 1.987 | 6.488 | 1.055 | 0.791 |
| GSGQNHRPSVLQQT | 380 | 1.983 | 5.582 | 0.433 | 0.582 |
| GSGSPRDSIQNQQT | 381 | 1.981 | 4.914 | 0.171 | 0.446 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQGIHSSVNQQT | 382 | 1.981 | 4.873 | 0.632 | 0.634 |
| GSGQQLSITPNQQT | 383 | 1.979 | 10.280 | 0.845 | 0.201 |
| GGYHSQTSGQNQQT | 384 | 1.978 | 2.642 | 1.740 | 1.525 |
| GSLHHDNHGQNQQT | 385 | 1.976 | 0.980 | 0.968 | 0.463 |
| GIMARDSSGQNQQT | 386 | 1.972 | 3.486 | 1.320 | 0.904 |
| GVVHITNSGQNQQT | 387 | 1.969 | 0.504 | 0.794 | 0.846 |
| GSGQNQHSAPFNQT | 388 | 1.969 | 0.499 | 0.759 | 0.870 |
| GSGQTSGLKQNQQT | 389 | 1.968 | 3.927 | 0.394 | 0.334 |
| GSGQNQQTSLSNTA | 390 | 1.959 | 1.186 | 1.567 | 1.182 |
| GSGQNQAVHNKSQT | 391 | 1.956 | 3.791 | 1.465 | 1.083 |
| GVHTHLPSGQNQQT | 392 | 1.952 | 1.364 | 1.414 | 0.796 |
| GHLTMHNSGQNHQT | 393 | 1.938 | 1.798 | 1.030 | 0.586 |
| GSGSSSRPYQNQQT | 394 | 1.934 | 3.823 | 0.962 | 0.496 |
| GILLATPSGQNQQT | 395 | 1.931 | 8.205 | 1.341 | 0.288 |
| GSGQNAGSFPNQQT | 396 | 1.928 | 12.575 | 1.091 | 0.286 |
| GSRDGHTVGQNQQT | 397 | 1.928 | 7.089 | 0.495 | 0.661 |
| GSLLISTSGQNQQT | 398 | 1.919 | 5.763 | 1.488 | 0.808 |
| GSGAMPSHGQNQQT | 399 | 1.915 | 0.000 | 1.142 | 0.912 |
| GALVSPISGQNQQT | 400 | 1.912 | 1.051 | 0.640 | 0.347 |
| GSLSSHGVGQNQQT | 401 | 1.911 | 7.498 | 1.218 | 0.804 |
| GSGQNQQASLAMRT | 402 | 1.910 | 3.577 | 2.066 | 1.638 |
| GPGLGSHSGQNQQT | 403 | 1.906 | 14.563 | 0.880 | 1.195 |
| GHDSQHKSGQNQQT | 404 | 1.904 | 6.988 | 1.154 | 0.869 |
| GSGLTLSATQNQQT | 405 | 1.901 | 0.193 | 0.708 | 0.340 |
| GSGQVVAHVGNQQT | 406 | 1.901 | 0.833 | 0.800 | 0.321 |
| GSGLRTMTTQNQQT | 407 | 1.900 | 8.939 | 0.838 | 0.594 |
| GSGQVGRLLQNQQT | 408 | 1.899 | 1.762 | 0.773 | 0.748 |
| GSGQLSHQSVNQQT | 409 | 1.898 | 4.032 | 0.720 | 0.695 |
| GSGDRYQTLQNQQT | 410 | 1.897 | 1.075 | 0.645 | 0.318 |
| GSGQNQQLKSSAQT | 411 | 1.891 | 1.197 | 0.908 | 0.716 |
| GSGQNQYSIPVAQT | 412 | 1.891 | 1.194 | 0.511 | 0.297 |
| GSGERLHLTQNQQT | 413 | 1.885 | 1.456 | 0.387 | 0.245 |
| GSGHNQQVRTAPNT | 414 | 1.885 | 1.022 | 1.006 | 0.580 |
| GGLSHVMSGQNQQT | 415 | 1.875 | 0.403 | 0.885 | 0.378 |
| GSGQSHRDVLNQQT | 416 | 1.872 | 15.082 | 0.138 | 0.280 |
| GSGQNLAGRMDQQT | 417 | 1.864 | 0.085 | 0.362 | 0.295 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQNQQTNRGNPM | 418 | 1.860 | 3.402 | 1.349 | 1.098 |
| GSGQSYQRDHNQQT | 419 | 1.859 | 8.013 | 0.779 | 0.323 |
| GSLLSAGMGQNQHT | 420 | 1.856 | 6.168 | 0.589 | 0.342 |
| GSGQNQQTAIYRNI | 421 | 1.854 | 2.207 | 0.818 | 1.437 |
| GSGQNQQTSGTTNC | 422 | 1.854 | 8.161 | 1.040 | 0.806 |
| GMTSHSVSGQNQQT | 423 | 1.850 | 2.732 | 0.220 | 0.154 |
| GSSQSTGYQPNQQT | 424 | 1.847 | 3.388 | 0.522 | 0.577 |
| GSLKPTTLGQNQQT | 425 | 1.840 | 0.476 | 0.175 | 0.220 |
| GRMFSLGSGQNQQT | 426 | 1.836 | 8.429 | 1.630 | 1.174 |
| GSGQNQQTALGVKC | 427 | 1.835 | 1.343 | 1.378 | 1.014 |
| GAMVSHSSGQNQQT | 428 | 1.833 | 8.999 | 0.739 | 0.868 |
| GSGQNQQRNSDSVT | 429 | 1.829 | 0.000 | 1.238 | 0.842 |
| GSGQSMTLHLNQQT | 430 | 1.827 | 0.991 | 0.721 | 0.248 |
| GSGQVHQAEVNQQT | 431 | 1.825 | 0.152 | 0.436 | 0.287 |
| GSGQNQSQNHLQQT | 432 | 1.825 | 0.600 | 1.063 | 0.772 |
| GSLLTTASGQNQQT | 433 | 1.822 | 0.780 | 0.938 | 0.635 |
| GSGLIRTAAQNQQT | 434 | 1.822 | 8.339 | 0.808 | 0.998 |
| GSGQNQQTVSRQST | 435 | 1.820 | 0.472 | 1.330 | 0.796 |
| GSGQYANHGINQQT | 436 | 1.820 | 5.717 | 0.906 | 0.701 |
| GSRSTGPSGQNQQT | 437 | 1.819 | 2.479 | 0.440 | 0.466 |
| GRGVQQKLQQNQQT | 438 | 1.817 | 0.000 | 1.974 | 0.823 |
| GSGQNQQVHLSTGT | 439 | 1.811 | 0.266 | 1.011 | 0.455 |
| GSGQNQQLSAKSST | 440 | 1.809 | 1.567 | 1.224 | 1.115 |
| GSGYKAARPQNQQT | 441 | 1.803 | 0.000 | 1.418 | 0.337 |
| GSAGISPSGQNQQT | 442 | 1.797 | 1.812 | 0.784 | 0.622 |
| GSGQNRAHAFLQQT | 443 | 1.795 | 0.000 | 1.200 | 1.271 |
| GSGLSGITMQNQQT | 444 | 1.792 | 14.796 | 0.862 | 0.496 |
| GPGSAHSSGQNQQT | 445 | 1.785 | 4.392 | 1.099 | 0.872 |
| GSSHTQALGQNQQT | 446 | 1.784 | 0.143 | 0.882 | 0.874 |
| GSGVHGVSSQNQQT | 447 | 1.781 | 4.519 | 1.504 | 0.951 |
| GSSGRDMGGQNQQT | 448 | 1.778 | 2.177 | 1.052 | 0.595 |
| GERAFPTSGQNQQT | 449 | 1.775 | 6.515 | 0.972 | 0.362 |
| GGRIVSLSGQNQQT | 450 | 1.766 | 4.936 | 1.161 | 0.847 |
| GSGQNSYSHTSQQT | 451 | 1.765 | 2.262 | 1.130 | 0.658 |
| GLGYPGSSGQNQQT | 452 | 1.763 | 7.090 | 0.929 | 0.577 |
| GSGPQSHTGQNQQT | 453 | 1.757 | 9.490 | 0.958 | 0.447 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQNQQLSRDAST | 454 | 1.754 | 3.716 | 1.877 | 0.611 |
| GSGQILHSVPNQQT | 455 | 1.752 | 1.316 | 0.398 | 0.240 |
| GSGFHTDSRQNQQT | 456 | 1.748 | 4.384 | 7.344 | 0.575 |
| GSGQSHSLATNQQT | 457 | 1.745 | 2.711 | 1.021 | 0.343 |
| GSGQNQQTLSKPWT | 458 | 1.743 | 0.253 | 0.845 | 0.733 |
| GSGHAAISQQNQQT | 459 | 1.742 | 2.373 | 1.211 | 0.520 |
| GSGQNQQIGGNST | 460 | 1.741 | 6.169 | 0.877 | 0.576 |
| GGGPMAGSGQNQQT | 461 | 1.735 | 2.815 | 1.049 | 0.372 |
| GMRMEYQSGQNQQT | 462 | 1.729 | 3.695 | 0.644 | 0.632 |
| GSGQNQQGTLLHQT | 463 | 1.728 | 2.065 | 1.347 | 1.303 |
| GSGQNQRSSGGVQT | 464 | 1.723 | 2.056 | 1.805 | 1.165 |
| GSGQNQRGALATQT | 465 | 1.722 | 1.117 | 0.899 | 0.891 |
| GSGTVHAATQNQQT | 466 | 1.721 | 1.676 | 0.563 | 0.476 |
| GSRMTQQFGQNQQT | 467 | 1.720 | 25.798 | 1.233 | 0.976 |
| GSSSPGASGQNQQT | 468 | 1.717 | 1.244 | 1.378 | 0.660 |
| GHPSPHVSGQNQQT | 469 | 1.713 | 0.416 | 0.551 | 0.488 |
| GSGSHHASRQNQQT | 470 | 1.712 | 0.451 | 3.073 | 0.584 |
| GAVGHSYSGQNQQT | 471 | 1.706 | 0.808 | 0.306 | 0.536 |
| GSRSQYDIGQNQQT | 472 | 1.706 | 0.112 | 0.528 | 0.193 |
| GSGQGPQERGNQQT | 473 | 1.702 | 1.269 | 0.846 | 0.313 |
| GSIAHVGTGQNQQT | 474 | 1.696 | 1.264 | 0.837 | 1.045 |
| GSGQNQQKQNHGNT | 475 | 1.695 | 5.349 | 1.538 | 1.340 |
| GSGQNQQALGSQRT | 476 | 1.695 | 1.934 | 1.419 | 0.562 |
| GSGAITHMPQNQQT | 477 | 1.695 | 1.681 | 0.647 | 0.411 |
| GSGQRNPLLLNQQT | 478 | 1.693 | 0.144 | 0.662 | 0.740 |
| GSSGIPVSHQNQQT | 479 | 1.690 | 3.384 | 0.820 | 0.333 |
| GVHSLTPSGQNQQT | 480 | 1.687 | 4.104 | 0.475 | 0.215 |
| GVIVLHGSGQNQQT | 481 | 1.682 | 14.166 | 1.074 | 1.098 |
| GGTRVVDSGQNQQT | 482 | 1.676 | 9.735 | 0.676 | 0.370 |
| GSGGVTYQSQNQQT | 483 | 1.673 | 7.283 | 0.649 | 0.181 |
| GSGQNQAGHGPGQT | 484 | 1.670 | 2.861 | 1.040 | 0.887 |
| GSGQLVTSGPNQQT | 485 | 1.669 | 5.271 | 0.964 | 0.433 |
| GSGIAAQRTQNQQT | 486 | 1.665 | 2.691 | 1.062 | 0.754 |
| GSTPAGVGGQNQQT | 487 | 1.663 | 2.733 | 0.593 | 0.477 |
| GSGQNQQTSTGVHS | 488 | 1.660 | 8.271 | 1.039 | 1.075 |
| GSGQIRQLVDNQQT | 489 | 1.657 | 5.529 | 0.314 | 0.272 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSLIGMQSGQNQQT | 490 | 1.656 | 6.783 | 0.797 | 0.392 |
| GSGQIKGKMDNQQT | 491 | 1.654 | 2.601 | 1.065 | 1.012 |
| GSGSDMSSWQNQQT | 492 | 1.651 | 0.175 | 0.281 | 0.303 |
| GRGQNQQHTGLATT | 493 | 1.650 | 6.174 | 1.134 | 0.691 |
| GSGQNQQTLYSSNT | 494 | 1.642 | 1.044 | 0.664 | 0.368 |
| GSGQTQVLKSNQQT | 495 | 1.640 | 3.031 | 1.599 | 0.975 |
| GSRTLSNVGQNQQT | 496 | 1.640 | 3.219 | 0.617 | 0.542 |
| GSGVQHSLPQNQQT | 497 | 1.639 | 0.764 | 0.440 | 0.387 |
| GNYLHQASGQNQQT | 498 | 1.635 | 1.454 | 0.816 | 0.181 |
| GSGGTSVHQQNQQT | 499 | 1.629 | 0.000 | 0.585 | 0.195 |
| GMDHSRPSGQNQQT | 500 | 1.627 | 3.976 | 0.918 | 0.648 |
| GSGQNQQSMGTFTT | 501 | 1.625 | 0.000 | 1.792 | 0.399 |
| GSGQNQQTPLRPPT | 502 | 1.624 | 0.352 | 0.874 | 0.472 |
| GSGQNQHHSVSQQT | 503 | 1.623 | 3.700 | 0.605 | 0.334 |
| GSGQLRSLSTNQQT | 504 | 1.622 | 6.855 | 1.310 | 0.382 |
| GSGSPRQLSQNQQT | 505 | 1.621 | 0.873 | 0.520 | 0.273 |
| GSGQNQQTTASSHT | 506 | 1.618 | 7.404 | 0.745 | 0.678 |
| GRGQVVSTHQNQQT | 507 | 1.607 | 3.318 | 0.931 | 0.561 |
| GSAQVSMVGQNQQT | 508 | 1.601 | 1.332 | 0.500 | 0.285 |
| GSSTLVTIGKNQQT | 509 | 1.592 | 4.316 | 0.917 | 0.819 |
| GFAHQASSGQNQQT | 510 | 1.587 | 1.852 | 1.638 | 1.080 |
| GSGQPVLSISNQQT | 511 | 1.586 | 2.695 | 0.390 | 0.282 |
| GSGQSHRSELNQQT | 512 | 1.585 | 11.974 | 0.668 | 0.256 |
| GSSVGSPIGQNQQT | 513 | 1.584 | 3.574 | 1.059 | 0.706 |
| GSGMPIRNVQNQQT | 514 | 1.584 | 0.138 | 0.684 | 0.631 |
| GSSTRVDSGQNQQT | 515 | 1.584 | 2.774 | 0.704 | 0.660 |
| GSGQNQQTAMRSTT | 516 | 1.581 | 2.588 | 0.656 | 0.665 |
| GSGQNQQHSSSHLT | 517 | 1.581 | 2.782 | 1.091 | 0.859 |
| GSRNGHAVGQNQQT | 518 | 1.574 | 2.688 | 0.434 | 0.939 |
| GLGAYQSSGQNQQT | 519 | 1.574 | 0.696 | 1.407 | 0.688 |
| GPGLSGHSGQNQQT | 520 | 1.571 | 1.603 | 1.154 | 1.297 |
| GSTGIVSSGQNQQT | 521 | 1.570 | 0.927 | 2.141 | 1.046 |
| GSRTTQVIGQNQQT | 522 | 1.570 | 1.838 | 0.773 | 0.564 |
| GSGLLHRAQQNQQT | 523 | 1.569 | 0.724 | 1.583 | 0.646 |
| GSGQNAQQAAAQQT | 524 | 1.568 | 4.239 | 0.937 | 0.604 |
| GSGQNQQSALRTQT | 525 | 1.568 | 1.913 | 1.581 | 1.421 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGFLSDTRQNQQT | 526 | 1.566 | 45.953 | 0.473 | 0.575 |
| GSGLLYHDQQNQQT | 527 | 1.565 | 2.760 | 0.405 | 0.107 |
| GSGQNQHYSLHKQT | 528 | 1.563 | 3.399 | 1.485 | 1.273 |
| GSGHSPLPQQNQQT | 529 | 1.562 | 0.556 | 0.387 | 0.247 |
| GNGHSMRPNQNQQT | 530 | 1.560 | 2.341 | 0.693 | 0.376 |
| GSGLKWSTLQNQQT | 531 | 1.556 | 0.000 | 1.134 | 2.442 |
| GSGQMGRQAVNQQT | 532 | 1.554 | 1.529 | 0.535 | 0.411 |
| GSGQNQQTSGVLTL | 533 | 1.553 | 0.000 | 1.104 | 0.782 |
| GSGQNQQALHNPHT | 534 | 1.553 | 0.664 | 0.638 | 0.213 |
| GSGQNQQVIPNSKT | 535 | 1.548 | 1.036 | 0.844 | 0.376 |
| GSPLQDRVGQNQQT | 536 | 1.548 | 0.753 | 0.469 | 0.391 |
| GSGQNQYSSTNPQT | 537 | 1.542 | 2.251 | 0.544 | 0.535 |
| GAMTVTISGQNQQT | 538 | 1.542 | 6.249 | 0.443 | 0.257 |
| GSGQNQQLQTLIRT | 539 | 1.538 | 1.425 | 0.813 | 0.514 |
| GSGLRQTSQQNQQT | 540 | 1.537 | 2.067 | 0.978 | 0.705 |
| GSGQNQQTGLRQQT | 541 | 1.533 | 2.120 | 1.217 | 1.103 |
| GSGQTRQMKDNQQT | 542 | 1.530 | 11.079 | 0.841 | 0.214 |
| GSGQNHGLQSGQQT | 543 | 1.530 | 4.960 | 0.938 | 0.779 |
| GSGQSHRQPENQQT | 544 | 1.529 | 2.153 | 0.209 | 0.159 |
| GSGQDRHIVQNQQT | 545 | 1.527 | 11.068 | 0.285 | 0.162 |
| GSGQNQQLPHSNLT | 546 | 1.521 | 1.838 | 0.442 | 0.283 |
| GSGQLSVPYDNQQT | 547 | 1.521 | 0.000 | 0.622 | 0.111 |
| GSGRNPQTQPLQQT | 548 | 1.519 | 0.040 | 0.733 | 0.573 |
| GSGQPYSTGLNQQT | 549 | 1.519 | 1.403 | 0.612 | 0.376 |
| GSGQNQQTHGGLRD | 550 | 1.519 | 6.487 | 1.913 | 1.298 |
| GAYGMVSSGQNQQT | 551 | 1.518 | 3.469 | 0.732 | 0.773 |
| GSGIQSSYSQNQQT | 552 | 1.517 | 15.978 | 1.032 | 0.684 |
| GPRLSDQSGQNQQT | 553 | 1.511 | 0.364 | 0.640 | 0.579 |
| GSGQNQQTHPSPCT | 554 | 1.510 | 1.003 | 1.120 | 0.546 |
| GSGQSFQMHTNQQT | 555 | 1.504 | 9.770 | 0.503 | 0.325 |
| GSGQNQQTGNPKHT | 556 | 1.504 | 5.973 | 1.391 | 1.139 |
| GFSSAVHSGQNQQT | 557 | 1.502 | 1.234 | 0.218 | 0.210 |
| GSGQNQQTSMSNAT | 558 | 1.501 | 6.766 | 1.605 | 0.745 |
| GSGQDMKQHHNQQT | 559 | 1.501 | 1.638 | 0.358 | 0.239 |
| GLRLSTPSGQNQQT | 560 | 1.498 | 4.334 | 0.804 | 0.522 |
| GSGQNQQTSVYMNT | 561 | 1.498 | 0.613 | 0.640 | 0.983 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQNQYSQSSMQT | 562 | 1.494 | 4.278 | 0.375 | 0.309 |
| GSGQNQQSMADHTT | 563 | 1.494 | 1.728 | 0.428 | 0.215 |
| GWERSFVSGQNQQT | 564 | 1.492 | 0.943 | 0.490 | 0.538 |
| GLLAGKSSGQNQQT | 565 | 1.491 | 2.981 | 0.999 | 0.946 |
| GKSFVPQSGQNQQT | 566 | 1.489 | 2.502 | 1.798 | 0.430 |
| GSGQMQSAGSNQQT | 567 | 1.482 | 0.116 | 1.034 | 1.128 |
| GSDQNQRLTSSMQT | 568 | 1.479 | 0.164 | 0.875 | 0.670 |
| GESRAVLSGQNQQT | 569 | 1.476 | 0.938 | 0.789 | 0.368 |
| GSVFGVPSGQNQQT | 570 | 1.474 | 1.248 | 0.685 | 0.213 |
| GSGLPDRNLQNQQT | 571 | 1.471 | 7.306 | 1.136 | 0.611 |
| GSGTHNSAIQNQQT | 572 | 1.469 | 0.570 | 0.762 | 0.574 |
| GSGMIIASMQNQQT | 573 | 1.469 | 6.722 | 1.135 | 0.415 |
| GGITWTDSGQNQQT | 574 | 1.462 | 4.535 | 1.472 | 0.468 |
| GSGQNQQASGRQQT | 575 | 1.458 | 3.179 | 0.943 | 0.991 |
| GSGQNQQPHLKSLT | 576 | 1.457 | 5.016 | 1.096 | 0.740 |
| GPPQHMTSGQNQQT | 577 | 1.457 | 1.547 | 0.509 | 0.677 |
| GSGQNQQASLPSRT | 578 | 1.456 | 0.389 | 0.930 | 0.673 |
| GSGQIVSTQTNQQT | 579 | 1.456 | 1.103 | 0.453 | 0.512 |
| GSGKGHSAGQNQQT | 580 | 1.453 | 0.936 | 1.035 | 1.173 |
| GSGQNTRLQLGQQT | 581 | 1.452 | 1.747 | 0.181 | 0.234 |
| GSVGSRPVGQNQQT | 582 | 1.442 | 11.363 | 1.182 | 0.716 |
| GSSHTLALGQNQQT | 583 | 1.441 | 7.071 | 0.851 | 0.406 |
| GMYEYSQSGQNQQT | 584 | 1.438 | 0.000 | 1.410 | 0.448 |
| GNGQNQQHSILHGT | 585 | 1.435 | 0.000 | 0.777 | 0.415 |
| GSGYNQPHLQNQQT | 586 | 1.435 | 4.512 | 0.711 | 0.395 |
| GPLVNASSGQNQQT | 587 | 1.434 | 5.239 | 0.831 | 0.343 |
| GSGQNQQVLTTART | 588 | 1.434 | 4.142 | 1.071 | 0.948 |
| GSGQNQHSVHNDQT | 589 | 1.428 | 0.000 | 0.521 | 0.515 |
| GAGLIMHSGQNQQT | 590 | 1.425 | 1.408 | 0.565 | 0.511 |
| GMGRHSASGQNQQT | 591 | 1.417 | 6.500 | 0.470 | 0.389 |
| GSHSQSGHGQNQQT | 592 | 1.413 | 1.240 | 0.696 | 0.318 |
| GSSTTIVSGQNHQT | 593 | 1.411 | 0.000 | 0.993 | 0.672 |
| GRHLVTASGQNQQT | 594 | 1.411 | 2.885 | 0.648 | 0.404 |
| GSGQNQQHANLNQT | 595 | 1.410 | 0.094 | 0.416 | 0.544 |
| GSGSTHSKAQNQQT | 596 | 1.410 | 0.515 | 0.921 | 0.801 |
| GSGQNKQMLSGNTT | 597 | 1.410 | 2.219 | 1.074 | 0.404 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQVHNPTQNQQT | 598 | 1.410 | 2.488 | 1.021 | 0.542 |
| GSGQNQQIPHVHQT | 599 | 1.409 | 0.768 | 0.576 | 0.218 |
| GSLHAGLSGQNQQT | 600 | 1.408 | 1.739 | 1.286 | 0.936 |
| GPAQHGTSGQNQQT | 601 | 1.407 | 0.866 | 1.030 | 0.615 |
| GEKAVTSSGQNQQT | 602 | 1.402 | 0.998 | 0.558 | 0.327 |
| GSGQNQQTMANGQR | 603 | 1.394 | 0.216 | 1.169 | 1.230 |
| GSGSPHSKDQNQQT | 604 | 1.394 | 0.000 | 2.041 | 4.680 |
| GSFSMGYGGQNQQT | 605 | 1.393 | 18.476 | 1.908 | 1.030 |
| GSGTHLVSLQNQQT | 606 | 1.392 | 0.000 | 0.715 | 1.167 |
| GSGQMQPHVQNQQT | 607 | 1.389 | 9.381 | 0.387 | 0.153 |
| GSGQNQQVAGLNNT | 608 | 1.386 | 3.218 | 0.449 | 0.492 |
| GSSQNQQHDMRLRT | 609 | 1.386 | 2.645 | 0.669 | 0.552 |
| GPASLPISGQNQQT | 610 | 1.386 | 9.008 | 0.312 | 0.155 |
| GSGQNQQPPLATRT | 611 | 1.386 | 2.295 | 0.593 | 0.287 |
| GSSRVPVSGQNQQT | 612 | 1.385 | 13.191 | 0.870 | 0.485 |
| GSGQNQQTNLGHTT | 613 | 1.383 | 1.523 | 1.343 | 1.281 |
| GSGQNQQLVSRVQT | 614 | 1.381 | 1.195 | 0.656 | 0.466 |
| GPNSYPVSGQKQQT | 615 | 1.381 | 4.040 | 0.736 | 0.834 |
| GHAHYQASGQNQQT | 616 | 1.377 | 7.299 | 0.803 | 0.745 |
| GSGQALLSTGNQQT | 617 | 1.377 | 0.847 | 0.536 | 0.370 |
| GSGQLPRQMTNQQT | 618 | 1.376 | 3.550 | 0.400 | 0.562 |
| GSGFPKSTEQNQQT | 619 | 1.376 | 2.058 | 0.610 | 0.194 |
| GSRETSLSGQNQQT | 620 | 1.373 | 5.193 | 1.364 | 0.203 |
| GSGQNQQGTGVSHT | 621 | 1.371 | 4.295 | 1.417 | 0.749 |
| GSRTVPVYGQNQQT | 622 | 1.371 | 0.363 | 1.226 | 0.969 |
| GSNAQSAHGQNQQT | 623 | 1.371 | 0.888 | 0.976 | 0.245 |
| GAFHLAASGQNQQT | 624 | 1.369 | 18.165 | 0.994 | 0.775 |
| GSGQYRSSSDNQQT | 625 | 1.369 | 6.209 | 0.681 | 0.409 |
| GSGQVYISTPNQQT | 626 | 1.367 | 0.000 | 0.859 | 0.282 |
| GSGVSTQLLQNQQT | 627 | 1.367 | 2.467 | 0.928 | 0.509 |
| GSGQLGLSVTNQQT | 628 | 1.364 | 6.906 | 1.395 | 0.376 |
| GSGSNMRLSQNQQT | 629 | 1.363 | 0.588 | 0.962 | 0.730 |
| GSGQNLHSGLPQQT | 630 | 1.363 | 1.594 | 1.054 | 0.592 |
| GSSHTLALGQNKQT | 631 | 1.362 | 2.160 | 0.838 | 0.643 |
| GSGQNQHSLPAHRT | 632 | 1.361 | 0.700 | 0.911 | 0.742 |
| GSGQNQGTVYPNQT | 633 | 1.358 | 7.648 | 0.835 | 0.815 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQNQQPSLRQST | 634 | 1.356 | 2.905 | 1.315 | 0.554 |
| GSGQNARLKDNQQT | 635 | 1.354 | 2.395 | 0.580 | 0.938 |
| GHAGSTGSGQNQQT | 636 | 1.352 | 2.829 | 1.332 | 1.233 |
| GSGQALSSSGNQQT | 637 | 1.351 | 6.860 | 0.894 | 0.931 |
| GSGASESHRQNQQT | 638 | 1.350 | 0.850 | 0.325 | 0.313 |
| GVGVITSSGNQQT | 639 | 1.348 | 0.918 | 1.296 | 0.777 |
| GSLYGQSLGQNQQT | 640 | 1.348 | 11.248 | 0.894 | 0.843 |
| GSGQMSDVHGNQQT | 641 | 1.346 | 7.172 | 0.408 | 0.548 |
| GSGQNQQHSSKATT | 642 | 1.345 | 12.248 | 1.350 | 1.401 |
| GSGQNQQTSVSQQT | 643 | 1.342 | 1.614 | 1.030 | 0.913 |
| GSGQKMWKLDNQQT | 644 | 1.341 | 0.000 | 0.990 | 1.418 |
| GSGQNVSMQVNQQT | 645 | 1.341 | 0.000 | 0.357 | 0.251 |
| GSGQNQRATLSNQT | 646 | 1.339 | 1.084 | 0.947 | 0.723 |
| GSGQASSKSANQQT | 647 | 1.339 | 1.138 | 0.500 | 0.175 |
| GSGKNQTPIPKGQT | 648 | 1.339 | 5.077 | 1.306 | 1.154 |
| GSGQNQQTRQEGST | 649 | 1.339 | 0.000 | 0.645 | 0.718 |
| GASSLATSGQNQQT | 650 | 1.337 | 0.703 | 0.423 | 0.217 |
| GSGQRGSLTENQQT | 651 | 1.337 | 2.482 | 0.300 | 0.567 |
| GSEQTRQRGQNQQT | 652 | 1.333 | 2.172 | 0.574 | 0.815 |
| GSGQNQQTLTASKE | 653 | 1.333 | 1.152 | 0.981 | 1.172 |
| GSGTSGKTGKNQQT | 654 | 1.333 | 4.033 | 0.358 | 0.676 |
| GQLVTFTSGQNQQT | 655 | 1.331 | 11.282 | 0.819 | 0.294 |
| GSGQNQQSANKILT | 656 | 1.331 | 3.789 | 0.894 | 1.236 |
| GSGQNQQHHSSHTT | 657 | 1.328 | 2.158 | 0.957 | 0.452 |
| GSGQNQKGMQPNQT | 658 | 1.326 | 3.139 | 0.775 | 1.059 |
| GSGQLVSGLYNQQT | 659 | 1.325 | 0.000 | 0.842 | 0.733 |
| GSSVGVPSGQNQQT | 660 | 1.322 | 4.867 | 0.336 | 1.157 |
| GSGQNQQWDSRRQT | 661 | 1.321 | 0.531 | 1.059 | 0.825 |
| GSEQTRQSGQNQQT | 662 | 1.321 | 0.514 | 0.734 | 0.900 |
| GSGIGSHIPQNQQT | 663 | 1.319 | 0.173 | 0.822 | 0.597 |
| GSGQNQRLHGVDQT | 664 | 1.318 | 4.655 | 0.459 | 0.341 |
| GEVSRVLSGQNQQT | 665 | 1.318 | 0.437 | 1.150 | 0.440 |
| GSGQNQQKVSPLLT | 666 | 1.314 | 1.602 | 0.755 | 0.806 |
| GSGLALERSQNQQT | 667 | 1.311 | 0.486 | 0.618 | 0.096 |
| GPDRIGSSGQNQQT | 668 | 1.308 | 0.426 | 0.654 | 0.342 |
| GSGQNQDHQNKQQT | 669 | 1.308 | 1.470 | 0.510 | 0.761 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQNQQTALYNNT | 670 | 1.307 | 0.862 | 0.660 | 0.726 |
| GSGAVHLTAQNQQT | 671 | 1.306 | 1.668 | 0.541 | 0.466 |
| GSLVSTQSGQNQQT | 672 | 1.305 | 1.293 | 1.282 | 0.650 |
| GSGVSARMVQNQQT | 673 | 1.299 | 0.624 | 0.870 | 0.697 |
| GSGQTRMPLANQQT | 674 | 1.296 | 0.790 | 0.447 | 0.273 |
| GSGISSRNMQNQQT | 675 | 1.291 | 6.328 | 1.671 | 0.560 |
| GSGEKVHSGQNQQT | 676 | 1.289 | 0.062 | 0.862 | 0.671 |
| GSGQNQQKLSSMST | 677 | 1.286 | 1.586 | 1.160 | 1.052 |
| GSGQNQQTGQHMRV | 678 | 1.286 | 4.161 | 1.839 | 1.635 |
| GSGMIHTTAQNQQT | 679 | 1.285 | 0.105 | 0.678 | 0.276 |
| GSGQNWPALKGQQT | 680 | 1.284 | 2.031 | 1.101 | 1.222 |
| GASHMSISGQNQQT | 681 | 1.284 | 0.462 | 0.404 | 0.374 |
| GSDQNQQLGYSKQT | 682 | 1.283 | 0.000 | 0.853 | 0.660 |
| GIPSIRESGQNQQT | 683 | 1.282 | 0.166 | 0.484 | 0.254 |
| GSGIPSVKFQNQQT | 684 | 1.281 | 0.061 | 0.364 | 0.561 |
| GSGQNQQTSVSQNV | 685 | 1.281 | 0.750 | 0.788 | 0.715 |
| GSGQNQQIGESRMT | 686 | 1.279 | 0.103 | 0.890 | 0.453 |
| GSGSSSMSFQNQQT | 687 | 1.279 | 0.540 | 0.466 | 0.095 |
| GSGKQERAVSKQT | 688 | 1.277 | 0.000 | 1.174 | 0.732 |
| GCTTRLNSGQNQQT | 689 | 1.276 | 0.000 | 0.184 | 0.618 |
| GSGQNQQIISTKIT | 690 | 1.275 | 0.000 | 0.951 | 0.710 |
| GSGQNQQKSLNGNT | 691 | 1.275 | 8.573 | 0.586 | 0.851 |
| GSGIPAPRLQNQQT | 692 | 1.273 | 4.162 | 0.583 | 0.396 |
| GSGQIRESMGNQQT | 693 | 1.270 | 1.676 | 0.833 | 0.523 |
| GSGQNSGVHFNQQT | 694 | 1.268 | 0.587 | 0.871 | 0.377 |
| GSGQNIGHSLPQQT | 695 | 1.264 | 6.183 | 0.740 | 0.478 |
| GSGERSISVQNQQT | 696 | 1.264 | 1.619 | 0.598 | 0.173 |
| GSGLKPNVLQNQQT | 697 | 1.263 | 0.975 | 0.701 | 0.268 |
| GSGQVAYAQGNQQT | 698 | 1.259 | 1.309 | 0.734 | 0.313 |
| GSGQSSYGSGNQQT | 699 | 1.257 | 1.686 | 1.161 | 0.456 |
| GSGQNQAMTHGDQT | 700 | 1.257 | 1.878 | 0.357 | 0.259 |
| GSGQNQALVSMGQT | 701 | 1.255 | 1.876 | 0.987 | 0.560 |
| GSGQNPSFMRGQQT | 702 | 1.252 | 1.454 | 1.293 | 1.094 |
| GSGQNQQSHLRINT | 703 | 1.251 | 4.583 | 1.022 | 0.718 |
| GYTRLETSGQNQQT | 704 | 1.250 | 1.323 | 0.841 | 0.297 |
| GSGQSYDMRGNQQT | 705 | 1.248 | 0.567 | 0.588 | 0.368 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSRTTQDIGQNQQT | 706 | 1.247 | 0.000 | 0.685 | 0.280 |
| GSGHPYKAAQNQQT | 707 | 1.246 | 0.000 | 0.872 | 0.507 |
| GRLSNAHGGQNQQT | 708 | 1.245 | 0.839 | 1.036 | 0.725 |
| GSGQNQRAVLNDQT | 709 | 1.242 | 3.023 | 0.556 | 0.259 |
| GGSHTYGGGQNQQT | 710 | 1.241 | 13.065 | 0.982 | 0.730 |
| GSSVNSMIGQNQQT | 711 | 1.239 | 0.000 | 0.976 | 0.580 |
| GNSSMMGSGQNQQT | 712 | 1.239 | 3.856 | 0.656 | 0.364 |
| GNRDRPSSGQNQQT | 713 | 1.239 | 3.947 | 0.298 | 0.178 |
| GSGNMHASRQNQQT | 714 | 1.238 | 3.878 | 0.782 | 0.687 |
| GFIFPKVSGQNQQT | 715 | 1.237 | 0.000 | 1.764 | 0.692 |
| GSGQNQQLKNSTST | 716 | 1.235 | 1.703 | 1.063 | 0.538 |
| GSGQNQQSQYMPRT | 717 | 1.234 | 0.401 | 0.549 | 0.520 |
| GSGQRMADIGNQQT | 718 | 1.233 | 2.539 | 0.352 | 0.427 |
| GSGQNQSHYPSQQT | 719 | 1.228 | 4.315 | 0.644 | 0.402 |
| GSDGKMHRGQNQQT | 720 | 1.227 | 0.000 | 1.826 | 0.776 |
| GSGSVGFIGQNQQT | 721 | 1.227 | 8.261 | 0.689 | 0.445 |
| GLHGMTLSGQNQQT | 722 | 1.226 | 3.552 | 0.470 | 0.338 |
| GSDQSKRGDSNQQT | 723 | 1.225 | 0.639 | 0.479 | 0.267 |
| GSLFLATGGQNQQT | 724 | 1.220 | 0.000 | 0.775 | 0.485 |
| GSGQNQQPSAFSKT | 725 | 1.220 | 4.906 | 1.309 | 0.754 |
| GSGQLPQSGLNQQT | 726 | 1.218 | 1.504 | 0.641 | 0.318 |
| GSGSKQNALQNQQT | 727 | 1.216 | 2.010 | 0.941 | 0.594 |
| GSGQRRELSQNQQT | 728 | 1.215 | 1.791 | 0.622 | 0.396 |
| GSGQREPKASNQQT | 729 | 1.214 | 2.793 | 0.399 | 0.520 |
| GSGQNQQHPSTQQT | 730 | 1.205 | 1.552 | 1.017 | 0.680 |
| GSQSTLGLGQNQQT | 731 | 1.204 | 3.246 | 0.594 | 0.400 |
| GSGQNQQMPGLSST | 732 | 1.204 | 1.887 | 0.234 | 0.181 |
| GSGQNQQTVGGKNL | 733 | 1.203 | 0.128 | 0.777 | 1.051 |
| GSSREFHSGQNQQT | 734 | 1.203 | 1.591 | 0.688 | 0.474 |
| GSGQNQQTVPSNLV | 735 | 1.201 | 0.791 | 0.434 | 0.281 |
| GSGQNAYSSQAQQT | 736 | 1.201 | 12.096 | 0.629 | 0.216 |
| GSGQNKDHSTRRQT | 737 | 1.197 | 0.000 | 0.384 | 0.477 |
| GQLGSVGSGQDQQT | 738 | 1.196 | 0.000 | 1.020 | 0.437 |
| GSGQHAAPGHNQQT | 739 | 1.195 | 5.999 | 0.600 | 0.199 |
| GSGQNQQTSQSPPT | 740 | 1.194 | 1.208 | 0.851 | 0.478 |
| GSGNYRDHEQNQQT | 741 | 1.193 | 7.389 | 0.287 | 0.222 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQHSNQHVNQQT | 742 | 1.192 | 1.453 | 0.955 | 0.558 |
| GSGQTARNGINQQT | 743 | 1.192 | 2.030 | 1.002 | 0.472 |
| GSGQNQQHYGSQGT | 744 | 1.189 | 0.453 | 1.345 | 0.379 |
| GSGSPQASRQNQQT | 745 | 1.189 | 6.782 | 0.923 | 0.542 |
| GSGFSHSMGKNQQT | 746 | 1.188 | 9.809 | 1.381 | 0.611 |
| GSGQSHSLETNQQT | 747 | 1.188 | 1.319 | 0.520 | 0.363 |
| GTEQTRQSGQNQQT | 748 | 1.188 | 0.132 | 0.756 | 0.756 |
| GSGRHLASVQNQQT | 749 | 1.187 | 1.024 | 0.654 | 0.606 |
| GLGSKNHSGQNQQT | 750 | 1.187 | 5.046 | 0.825 | 0.224 |
| GSGQNQQTSHFPSA | 751 | 1.185 | 0.325 | 0.969 | 0.907 |
| GSGQLSGTPQNQQT | 752 | 1.185 | 1.382 | 1.025 | 0.643 |
| GSGQNQQAPHKKET | 753 | 1.180 | 0.598 | 0.994 | 0.689 |
| GSGQNQQTLRGSLE | 754 | 1.179 | 1.812 | 0.853 | 0.354 |
| GSIAMTSHGQNQQT | 755 | 1.178 | 1.435 | 0.551 | 0.438 |
| GSPGVSPSGQNQQT | 756 | 1.178 | 3.006 | 0.853 | 1.160 |
| GSGQNQQTGSSSRV | 757 | 1.176 | 0.580 | 0.995 | 1.128 |
| GSGQHLPLLGNQQT | 758 | 1.175 | 1.739 | 0.519 | 0.347 |
| GSDHSRGGQNQQT | 759 | 1.174 | 0.504 | 0.818 | 0.331 |
| GSGIVTKLGQNQQT | 760 | 1.174 | 10.571 | 0.599 | 0.242 |
| GSGQDVTKTGNQQT | 761 | 1.173 | 4.523 | 0.531 | 0.035 |
| GSGQNQQSHGRIGT | 762 | 1.173 | 5.117 | 0.607 | 0.455 |
| GSGQNQQINHRSPT | 763 | 1.173 | 0.748 | 0.259 | 0.220 |
| GSGDDSRVGQNQQT | 764 | 1.172 | 0.191 | 0.466 | 0.156 |
| GSGQSTLKRINQQT | 765 | 1.168 | 13.442 | 0.534 | 1.184 |
| GSGSQHSKAQNQQT | 766 | 1.168 | 0.312 | 0.638 | 0.916 |
| GSGQNQQHASSNNT | 767 | 1.166 | 7.155 | 0.789 | 0.896 |
| GSRTYQVSGQNQQT | 768 | 1.164 | 1.853 | 0.638 | 0.641 |
| GSGQNQGLLSSPQT | 769 | 1.164 | 0.000 | 0.707 | 0.417 |
| GSGGGLQHNQNQQT | 770 | 1.163 | 4.098 | 1.137 | 0.778 |
| GSGQNQQTTAATRM | 771 | 1.163 | 3.925 | 0.947 | 1.005 |
| GSGQNQRASILVQT | 772 | 1.162 | 3.632 | 0.531 | 0.569 |
| GSGQNLGLLGAQQT | 773 | 1.161 | 1.458 | 0.524 | 0.226 |
| GSLDLGRSGQNQQT | 774 | 1.160 | 3.283 | 1.002 | 0.505 |
| GNSQVKVSGQNQQT | 775 | 1.158 | 4.930 | 1.422 | 0.728 |
| GSSGSHQYGQNQQT | 776 | 1.155 | 0.000 | 1.129 | 0.794 |
| GSGQNQQQRDGTLT | 777 | 1.152 | 0.387 | 0.760 | 0.730 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GRGQHVSVANNQQT | 778 | 1.152 | 1.896 | 1.032 | 0.589 |
| GDSSSRISGQNQQT | 779 | 1.151 | 3.787 | 0.916 | 0.348 |
| GSGQNQQHSLSSQT | 780 | 1.150 | 3.844 | 0.700 | 0.730 |
| GSLMDVHRGQNQQT | 781 | 1.150 | 0.387 | 1.009 | 0.238 |
| GSIQYQSSGQNQQT | 782 | 1.147 | 2.601 | 1.074 | 1.191 |
| GLGSKNPSGQNQQT | 783 | 1.147 | 1.629 | 1.184 | 0.424 |
| GSGQLVLTLQNQQT | 784 | 1.143 | 0.000 | 0.336 | 0.336 |
| GSGQNQQTSQPLPG | 785 | 1.141 | 0.080 | 0.748 | 0.530 |
| GSGQNQQNLGKLNT | 786 | 1.141 | 0.000 | 0.919 | 0.687 |
| GTTAHQPSGQNQQT | 787 | 1.138 | 0.211 | 0.726 | 0.275 |
| GSGQNRAQIGTQQT | 788 | 1.138 | 0.469 | 0.776 | 0.654 |
| GSGQYVHVSSNQQT | 789 | 1.137 | 1.803 | 0.739 | 0.366 |
| GSGQNQQTAHAFNI | 790 | 1.132 | 3.404 | 0.699 | 0.729 |
| GSGQNQRTMVATQT | 791 | 1.130 | 1.122 | 0.649 | 0.554 |
| GSGQNPIRGAMQQT | 792 | 1.126 | 1.327 | 1.296 | 0.427 |
| GSGYVITGSQNQQT | 793 | 1.125 | 6.271 | 0.971 | 0.248 |
| GRGPKQSNIQNQQT | 794 | 1.125 | 0.737 | 0.771 | 2.490 |
| GSGQNQQTMLGKPC | 795 | 1.125 | 0.047 | 1.090 | 0.992 |
| GSGQNQQVGSTVRT | 796 | 1.124 | 2.040 | 0.918 | 0.614 |
| GNVTTQKSGQNQQT | 797 | 1.122 | 2.546 | 1.215 | 0.922 |
| GSGNPVSHLQNQQT | 798 | 1.121 | 1.037 | 0.583 | 0.310 |
| GSLSHMESGQNQQT | 799 | 1.120 | 0.829 | 0.489 | 0.265 |
| GRAPTNLSGQNQQT | 800 | 1.118 | 0.687 | 0.757 | 0.169 |
| GSGQNQQTVMTARA | 801 | 1.117 | 1.535 | 0.995 | 0.843 |
| GSGMPASRLQNQQT | 802 | 1.117 | 1.689 | 0.790 | 0.372 |
| GVVRNHQSGQNQQT | 803 | 1.116 | 5.801 | 0.899 | 0.868 |
| GSGQNQHSVQVRQT | 804 | 1.116 | 1.909 | 0.782 | 0.916 |
| GSGQNTGHLTMQQT | 805 | 1.114 | 0.078 | 1.026 | 0.595 |
| GSGQNQQYAGKILT | 806 | 1.112 | 0.300 | 1.078 | 0.431 |
| GSGNPHVRNQNQQT | 807 | 1.112 | 0.873 | 0.732 | 0.755 |
| GSGQNGGSSNRQQT | 808 | 1.109 | 2.594 | 1.255 | 0.844 |
| GSGQRLSQGVNHQT | 809 | 1.108 | 3.394 | 0.931 | 1.141 |
| GSGQNAHAKEGQQT | 810 | 1.108 | 0.000 | 0.875 | 1.179 |
| GSSPAPNSGQNQQT | 811 | 1.106 | 2.229 | 0.719 | 0.368 |
| GLAHKTSSGQNQQT | 812 | 1.106 | 0.915 | 0.427 | 0.690 |
| GSGQNQQTPGAHKT | 813 | 1.105 | 3.827 | 0.957 | 0.277 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQNQQSLSGSFT | 814 | 1.105 | 0.735 | 0.745 | 0.883 |
| GSGQNQQSTGTSRT | 815 | 1.103 | 4.054 | 1.209 | 0.935 |
| GSGQNQQTVQSNLV | 816 | 1.103 | 2.350 | 0.577 | 0.698 |
| GSGQNQQLGSRQCT | 817 | 1.102 | 0.183 | 0.987 | 0.407 |
| GSGQNQYLRLELQT | 818 | 1.101 | 0.000 | 0.416 | 0.839 |
| GSGQNQQTSPRLQT | 819 | 1.100 | 0.795 | 1.156 | 1.091 |
| GSGQNQQTTSSNMT | 820 | 1.099 | 0.569 | 0.638 | 0.698 |
| GTASTYNSGQNQQT | 821 | 1.099 | 2.560 | 0.250 | 0.625 |
| GSGQNQQTMPQHKI | 822 | 1.097 | 2.394 | 0.479 | 0.197 |
| GSGQSHLHTGNQQT | 823 | 1.096 | 2.584 | 0.721 | 0.295 |
| GVKGVGHSGQNQQT | 824 | 1.096 | 2.485 | 0.994 | 0.783 |
| GSGKVTKQSQNQQT | 825 | 1.095 | 0.000 | 0.928 | 1.035 |
| GSGQNQQTALEKSL | 826 | 1.092 | 0.000 | 0.625 | 0.702 |
| GSGYKDTYGQNQQT | 827 | 1.091 | 0.854 | 0.717 | 0.448 |
| GSGQNQQSGTFLST | 828 | 1.090 | 5.673 | 1.021 | 0.742 |
| GSGQNTGQHMMQQT | 829 | 1.090 | 1.058 | 1.147 | 0.917 |
| GSGKNQQRPGLDQT | 830 | 1.089 | 1.557 | 0.583 | 0.385 |
| GSGQSREISLNQQT | 831 | 1.088 | 6.954 | 0.594 | 0.282 |
| GTPTSPSSGQNQQT | 832 | 1.086 | 4.558 | 0.833 | 0.662 |
| GKPAGGLSGQNQQT | 833 | 1.085 | 2.805 | 0.708 | 0.739 |
| GSGQNHRSADMQQT | 834 | 1.084 | 12.001 | 0.417 | 0.212 |
| GSGQNQQTLPSLSL | 835 | 1.084 | 1.758 | 0.527 | 0.175 |
| GSPYMGATGQNQQT | 836 | 1.083 | 5.364 | 0.918 | 0.254 |
| GSGHAKAVGQNQQT | 837 | 1.081 | 4.357 | 0.703 | 0.824 |
| GHMKGVTSGQNQQT | 838 | 1.081 | 2.814 | 0.807 | 0.413 |
| GSGQNQKILTLDQT | 839 | 1.080 | 0.371 | 0.291 | 0.314 |
| GSGQNQQTKVGHSA | 840 | 1.079 | 1.256 | 0.669 | 1.019 |
| GIARTTISGQNQQT | 841 | 1.078 | 1.783 | 0.819 | 0.330 |
| GSGQNQQTSVGFRT | 842 | 1.077 | 3.737 | 0.648 | 0.534 |
| GSGQNQQTMIANIR | 843 | 1.076 | 0.000 | 0.379 | 0.458 |
| GDMTRSSSGQNQQT | 844 | 1.075 | 0.802 | 1.145 | 1.038 |
| GSGHMSDLRQNQQT | 845 | 1.073 | 4.291 | 0.555 | 0.328 |
| GRGAVMASGQNQQT | 846 | 1.072 | 0.923 | 0.783 | 0.605 |
| GSGQNQQLSGKSVT | 847 | 1.070 | 1.524 | 1.276 | 0.930 |
| GSHTLVVSGQNQQT | 848 | 1.069 | 1.535 | 0.671 | 0.748 |
| GSGPWSAGLQNQQT | 849 | 1.067 | 0.947 | 0.700 | 0.539 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQHSPHALNQQT | 850 | 1.064 | 1.412 | 0.885 | 0.573 |
| GSGQNQQPNSGSMT | 851 | 1.064 | 0.925 | 0.588 | 0.339 |
| GSGLAHLGGQNQQT | 852 | 1.064 | 2.191 | 0.749 | 0.794 |
| GSSVRYEPKQNQQT | 853 | 1.063 | 1.564 | 0.450 | 0.501 |
| GSGQNQQARPLELT | 854 | 1.061 | 0.059 | 0.389 | 0.252 |
| GSGQPRSTGINQQT | 855 | 1.061 | 0.693 | 0.650 | 0.542 |
| GSGQNQANWVKVQT | 856 | 1.059 | 0.126 | 0.683 | 0.532 |
| GSGHLFQSGQNQQT | 857 | 1.057 | 0.615 | 0.751 | 0.386 |
| GSGQNRGISISQQT | 858 | 1.057 | 2.166 | 0.686 | 0.566 |
| GSGTHYDNRQNQQT | 859 | 1.054 | 0.072 | 0.612 | 0.486 |
| GSGQNQQTSTTPLP | 860 | 1.052 | 2.823 | 0.828 | 0.741 |
| GSGQVHASQVNQKT | 861 | 1.049 | 0.503 | 0.855 | 0.767 |
| GSSGHRESGQNQQT | 862 | 1.048 | 4.398 | 0.641 | 0.691 |
| GLSAEKSSGQNQQT | 863 | 1.047 | 7.203 | 0.629 | 0.303 |
| GSGQEHRSLANQQT | 864 | 1.046 | 0.000 | 0.507 | 0.344 |
| GSGQTVVRIANQQT | 865 | 1.046 | 4.156 | 0.661 | 0.390 |
| GSGQNVSSVHRQQT | 866 | 1.045 | 0.712 | 0.383 | 0.271 |
| GSGASRMSIQNQQT | 867 | 1.045 | 0.111 | 0.801 | 0.417 |
| GVAFIGSSGQNQQT | 868 | 1.043 | 0.000 | 0.744 | 0.648 |
| GSGQNQQTVPTRQT | 869 | 1.040 | 1.207 | 0.629 | 0.138 |
| GSGQAAKSSQNQQT | 870 | 1.036 | 0.681 | 0.778 | 0.737 |
| GSGQNQQVAIRTST | 871 | 1.035 | 2.447 | 0.963 | 0.370 |
| GSVHMQNAGQNQQT | 872 | 1.034 | 3.608 | 1.004 | 0.625 |
| GSGMRQAGVQNQQT | 873 | 1.032 | 0.811 | 0.736 | 0.775 |
| GSGQNQQVGGKTVT | 874 | 1.032 | 6.195 | 1.094 | 0.821 |
| GVHDMRVSGQNQQT | 875 | 1.032 | 8.083 | 1.171 | 0.818 |
| GSGQHVSVANNQQT | 876 | 1.029 | 5.734 | 0.974 | 0.577 |
| GSAAMSVRGQNQQT | 877 | 1.029 | 2.386 | 0.202 | 0.287 |
| GVSRGGPSGQNQQT | 878 | 1.028 | 1.611 | 0.750 | 0.591 |
| GSGQMVHTIGNQQT | 879 | 1.026 | 1.328 | 0.406 | 0.430 |
| GRGGSMAETQNQQT | 880 | 1.024 | 2.853 | 0.799 | 0.669 |
| GSGHTNPTRQNQQT | 881 | 1.021 | 0.688 | 0.726 | 0.807 |
| GSGEAARYEQNQQT | 882 | 1.020 | 0.000 | 0.107 | 0.125 |
| GSGQNERHLVLQQT | 883 | 1.019 | 5.354 | 0.416 | 0.150 |
| GSGQNQQSKQQVLT | 884 | 1.019 | 1.494 | 1.428 | 1.256 |
| GSGQARAHRGNQQT | 885 | 1.017 | 0.000 | 0.254 | 0.386 |

TABLE 9-continued

NGS fold-enrichment of AAV capsid variants in NHPs and mice

| Peptide Sequence | SEQ ID NO: | Fold enrichment over AAV9 in the brain of NHPs | Fold enrichment over AAV9 in the spinal cord of NHPs | Fold enrichment over AAV9 in the brain of Mice (C57Bl/6) | Fold enrichment over AAV9 in the brain of Mice (BALB/c) |
|---|---|---|---|---|---|
| GSGQNQQPLDTSRT | 886 | 1.015 | 0.775 | 0.491 | 0.376 |
| GSGQNQQLANMVTT | 887 | 1.014 | 1.739 | 1.253 | 0.987 |
| GSGQMKDLHRNQQT | 888 | 1.014 | 1.068 | 0.587 | 0.506 |
| GSGQNQHLSSFVQT | 889 | 1.013 | 0.110 | 1.090 | 0.364 |
| GSGQNQQPSSRVTT | 890 | 1.012 | 2.179 | 0.784 | 0.504 |
| GSGQNQQLAITLGT | 891 | 1.011 | 0.000 | 0.877 | 0.143 |
| GSGQNQQTVGNPAT | 892 | 1.008 | 3.014 | 0.856 | 0.395 |
| GSGQNQGRAHPMQT | 893 | 1.007 | 2.364 | 0.684 | 0.453 |
| GSGQLIASVVNQQT | 894 | 1.005 | 0.086 | 0.197 | 0.359 |
| GSSVRSLVGQNQQT | 895 | 1.004 | 3.840 | 0.412 | 0.608 |
| GGAGSAHSGQNQQT | 896 | 1.003 | 6.108 | 0.474 | 1.092 |
| GSDQNQQTMSSTRT | 897 | 1.003 | 2.428 | 1.306 | 0.835 |
| GSGQNQQMAGAFRT | 898 | 1.003 | 1.784 | 1.307 | 0.762 |
| GSLGNLQRGQNQQT | 899 | 1.003 | 0.895 | 0.947 | 0.385 |
| GSGPSISHGQNQQT | 900 | 1.000 | 0.000 | 0.614 | 0.665 |
| GSGQNQQT | 6406 | 1.000 | 1.000 | 1.000 | 1.000 |
| GSGQNQQSSFNVQT | 901 | 0.998 | 0.000 | 1.307 | 0.675 |
| GSGQNQQTGQATHN | 902 | 0.996 | 2.199 | 0.877 | 0.527 |

A second cross-species evolution screen was performed using an AAV capsid variant library with a modification in loop IV introduced as described above and passaging it once through NHPs (passage 1) and then subsequently injected it into two different strains of mice (passage 2), C571Bl/6 and BALB/c. The fold-enrichment for each variant in the brain of each mouse species was calculated by systematic NGS enrichment analysis following RNA recovery and RT-PCR amplification. The fold enrichment values in the second passage in mice were compared to those fold enrichment values from the second pass that was performed in NHPs as described above. As shown in Table 10, when comparing the second pass fold enrichment values in the mice versus NHPs, 12 variants were identified that had a fold-enrichment value greater than 10 in all three animal groups. Further, 10 of these 12 variants comprised the SPH motif and a positive residue in one of the next three subsequent residues (Table 10).

TABLE 10

NGS fold-enrichment of AAV capsid variants from a second passage (P2) in NHPs or mice (C57Bl/6 or BALB/c) following a first passage in NHPs

| Peptide Sequence | SEQ ID NO: | Fold enrichment over AAV9 in NHP P2 | Fold enrichment over AAV9 in BALB/c P2 | Fold enrichment over AAV9 in C57Bl/6 P2 |
|---|---|---|---|---|
| VSGSPHSKAQNQQT | 903 | 99.76 | 92.99 | 34.29 |
| CSGSPHSKAQNQQT | 904 | 85.1 | 66.74 | 22.19 |
| GSGSPHSKAQNQQT | 200 | 56.33 | 44.58 | 14.48 |
| GSGSPHRKAQNQQT | 905 | 46.39 | 42.47 | 14.11 |
| GRGSPHSKAQNQQT | 906 | 43.68 | 59.65 | 28.13 |
| GHDSPHKSGQNQQT | 201 | 33.96 | 59.14 | 27.15 |
| GSGSPHSKAKNQQT | 208 | 31.27 | 41.51 | 14 |

TABLE 10-continued

NGS fold-enrichment of AAV capsid variants from a second passage (P2) in NHPs or mice (C57B1/6 or BALB/c) following a first passage in NHPs

| Peptide Sequence | SEQ ID NO: | Fold enrichment over AAV9 in NHP P2 | Fold enrichment over AAV9 in BALB/c P2 | Fold enrichment over AAV9 in C57B1/6 P2 |
|---|---|---|---|---|
| GSGSPHSKAQNKQT | 907 | 29.52 | 44.1 | 13.69 |
| GSGSPHSKAQTQQT | 908 | 24.27 | 41.75 | 18 |
| GQDSPHKSGQNQQT | 204 | 22.7 | 32.37 | 16.02 |
| GSGSTHASRQNQQT | 909 | 11.04 | 23.71 | 10.67 |
| GHDSQHKSGQNQQT | 404 | 10.36 | 21.3 | 13.55 |

Following the second passage in mice, a synthetic library was generated using those variants that demonstrated a fold-change in enrichment relative to wild-type AAV9 that was above 10 in the brain of either strain of mice, as measured by systematic NGS enrichment analysis following RNA recovery and RT-PCR amplification. There were approximately 500 variants in this synthetic library. This synthetic library was then injected back into both strains of mice (C57B1/6 and BALB/c; passage 3). RNA was recovered from the mouse brains, RT-PCR amplification was performed, and fold-enrichment relative to wild-type AAV9 was calculated by NGS analysis, which is provided in Table 11. As shown in Table 11, the variants with the greatest fold-enrichment in the brain in each strain, were highly correlated across strains ($R^2=1.8458$).

TABLE 11

NGS fold-enrichment of AAV capsid variants in the brain from a third passage (P3) in mice (C57B1/6 or BALB/c) following a first and second passage in mice

| Peptide Sequence | SEQ ID NO: | Fold enrichment over AAV9 in BALB/c | Fold enrichment over AAV9 in C57B1/6 | Average |
|---|---|---|---|---|
| GSGSPHKYGQNQQT | 910 | 150.445 | 103.488 | 126.966 |
| GSGSPHKFGQNQQT | 911 | 73.364 | 60.304 | 66.834 |
| GHDSPHKSGQNQQT | 201 | 82.460 | 51.125 | 66.792 |
| GSGSPHSKAQNQQT | 200 | 60.312 | 65.853 | 63.083 |
| VSGSPHKFGQNQQT | 912 | 60.186 | 59.142 | 59.664 |
| GSGSPHSKAQNHQT | 913 | 63.486 | 51.647 | 57.566 |
| VSGSPHSKAQNQQT | 903 | 73.555 | 37.429 | 55.492 |
| GQDSPHKSGQNQQT | 204 | 63.898 | 43.752 | 53.825 |
| GSGSPHSKAQHQQT | 914 | 45.309 | 45.600 | 45.454 |
| GSGSPHKTYQNQQT | 915 | 50.283 | 35.460 | 42.871 |
| GSGSPHSKAQTQQT | 908 | 43.120 | 39.098 | 41.109 |
| VSGSPHASRQNQQT | 916 | 46.572 | 32.480 | 39.526 |
| GSGSPHSKAQNKQT | 907 | 39.848 | 35.596 | 37.722 |
| GSGSPHKFGKNQQT | 917 | 31.948 | 34.899 | 33.423 |
| GSGSPHASRQNQHT | 918 | 28.145 | 30.928 | 29.537 |
| GSHSPHKSGQNQQT | 919 | 22.948 | 35.412 | 29.180 |
| GSGQNQQRRMSPST | 920 | 4.576 | 53.520 | 29.048 |
| GSGSPHASRQNQQT | 205 | 28.866 | 29.139 | 29.003 |
| GSGSPHSKPQNQQT | 921 | 26.958 | 28.599 | 27.779 |
| GSGSPHKFGQKQQT | 922 | 39.597 | 14.927 | 27.262 |

TABLE 11-continued

NGS fold-enrichment of AAV capsid variants in the brain from a third passage (P3) in mice (C57Bl/6 or BALB/c) following a first and second passage in mice

| Peptide Sequence | SEQ ID NO: | Fold enrichment over AAV9 in BALB/c | Fold enrichment over AAV9 in C57Bl/6 | Average |
|---|---|---|---|---|
| VSGSPHGARQNQQT | 923 | 30.985 | 22.634 | 26.810 |
| GSGSPHSKAQKQQT | 924 | 25.052 | 27.459 | 26.256 |
| GHSSPHRSGQNQQT | 212 | 16.982 | 35.081 | 26.032 |
| GSGSPHSKAKNQQT | 208 | 21.069 | 25.711 | 23.390 |
| GSHSPHKRGQNQQT | 925 | 24.054 | 20.262 | 22.158 |
| GRGSPHSKAQNQQT | 906 | 20.939 | 22.720 | 21.830 |
| GQSSPHRSGQNQQT | 229 | 9.916 | 26.608 | 18.262 |
| GSGQNRQRLKGLET | 926 | 3.937 | 31.022 | 17.480 |
| GSGSPHKLGQNQQT | 927 | 18.905 | 14.732 | 16.818 |
| GSGSPHKTSKNQQT | 928 | 14.654 | 17.606 | 16.130 |
| GSGSPHKIGQNQQT | 929 | 16.999 | 14.794 | 15.897 |
| GSGSPHKKNQNQQT | 209 | 25.633 | 5.605 | 15.619 |
| GSGSPHASRQNKQT | 206 | 10.738 | 20.347 | 15.542 |
| GSGSPHTRGQNQQT | 214 | 16.899 | 13.869 | 15.384 |
| GSGQDSPHVRNQQT | 930 | 15.340 | 14.646 | 14.993 |
| GSGSPHKTSQNQQT | 931 | 20.428 | 8.818 | 14.623 |
| GSGSPHASRKNQQT | 932 | 13.799 | 12.749 | 13.274 |
| GSGSPHASRQKQQT | 211 | 13.624 | 11.188 | 12.406 |
| GSHSPHKSGQKQQT | 933 | 6.700 | 17.736 | 12.218 |
| GSGSPHKTSQKQQT | 934 | 12.621 | 11.720 | 12.170 |
| GSGSPHVRGQNKQT | 935 | 13.174 | 11.017 | 12.095 |
| GSGSPHKTTQNQQT | 936 | 9.722 | 13.381 | 11.552 |
| CSGSPHSKAQNQQT | 904 | 11.772 | 9.447 | 10.610 |
| GSGPVRALRQNQQT | 937 | 3.369 | 17.431 | 10.400 |
| GSGSPHVRGQKQQT | 938 | 7.573 | 12.498 | 10.036 |
| GSGSPHRKAQNQQT | 905 | 12.308 | 7.349 | 9.828 |
| GRGSPHASRQNQQT | 318 | 11.903 | 6.780 | 9.342 |
| CSGSPHKTSQNQQT | 939 | 11.167 | 6.631 | 8.899 |
| CSHSPHKSGQNQQT | 940 | 11.356 | 6.304 | 8.830 |
| GSGSPHSKDQNQQT | 604 | 3.492 | 10.236 | 6.864 |

Taken together, these results demonstrate that after 3 rounds of screening of this AAV9 variant library with loop IV modifications in NHP and mice, many AAV capsid variants outperformed the wild-type AAV9, for example, in penetration of the blood brain barrier (BBB) and spinal cord expression. These capsid variants were able to cross-species, evidenced by expression and tropism in the NHP brain/spinal cord as well as in the brain of two different mouse species.

Example 2. Individual Capsid Characterization in Mice

The goal of these experiments was to determine the transduction level, tropism, ability to cross the blood brain barrier, and overall spatial distribution in the central nervous system (CNS) of 2 capsid variants selected from the study described in Example 1 relative to AAV9 following intravenous injection in mice. The 2 capsid variants were TTM-001 (SEQ ID NO: 981 (amino acid) and 983 (DNA), comprising SEQ ID NO: 941) and TTM-002 (SEQ ID NO: 982 (amino acid) and 984 (DNA), comprising SEQ ID NO: 2), as outlined in Table 3 above. The amino acid and DNA sequences of TTM-001 and TTM-002 are provided, e.g., in Tables 4 and 5, respectively.

AAV particles were generated with each of these capsid variants encapsulating a luciferase-EGFP transgene driven by a CMV/chicken beta actin promoter in a single stranded viral genome. Each capsid variant and AAV9 control were tested by intravenously administering by tail vein injection, the AAV particle formulation at 5e11 VG/dose (2.5E13 vg/kg) to three female BALB/c mice. The in-life period was 28 days and then various CNS and peripheral tissues were collected for measuring transgene mRNA, transgene protein, and viral DNA (biodistribution).

At 28 days post-injection of the AAV particles encapsulated in the TTM-001 capsid variant (AAV_TTM-001), mice were injected with luciferin and their brains were harvested for IVIS imaging. Robust luciferase signal was observed in mice injected with AAV particles encapsulated in the TTM-001 capsid variant, and this was greatly increased relative to AAV particles encapsulated in the wild-type AAV9 control capsid.

The brains isolated from mice injected with the AAV particles encapsulated in the TTM-001 capsid variant (AAV_TTM-001) or the TTM-002 capsid variant (AAV_TTM-002) were assayed by qPCR for the presence of transgene RNA as a measure of transgene expression, and the presence of viral DNA as a measure of viral genome levels. Data were provided as fold over AAV9 (Table 12). As shown in Table 12, when compared to the wild-type AAV9 capsid control, TTM-001 and TTM-002 demonstrated a 30-fold and 66-fold increase, respectively, in transgene mRNA levels and expression in the brain, indicative of enhanced payload delivery. This correlated with a 32-fold (TTM-001) and 47-fold (TTM-002) increase, respectively, in viral genome (DNA) concentrations in the brain relative to the AAV9 capsid control, which is indicative of enhanced CNS tropism and transduction (Table 12).

TABLE 12

Transgene mRNA and viral genome levels (DNA) in mice relative to the AAV9 control

| Measure | Tissue | AAV9 | TTM-001 | TTM-002 |
|---|---|---|---|---|
| mRNA (transgene expression) | Brain | 1.0 | 30.4503 | 66.2161 |
| DNA (viral genome quantification) | Brain | 1.0 | 32.0315 | 47.2810 |
| mRNA (transgene expression) | Liver | 1.0 | 1.2356 | 0.2016 |
| DNA (viral genome quantification) | Liver | 1.0 | 0.4802 | 0.0277 |

The brain tissues and spinal cords of the mice were also subjected to anti-GFP immunohistochemistry staining to evaluate overall CNS tropism and biodistribution. Immunohistochemical staining correlated with the qPCR analysis, as TTM-001 and TTM-002 showed significantly stronger staining and payload expression in the brain and spinal cord, as compared to the AAV9 control. More specifically, TTM-001 and TTM-02 demonstrated localization and strong payload expression and transduction in the mid-brain region, with increased staining observed in the hippocampus and thalamus, as well as in the brain stem, compared to AAV9. Less staining was observed in the cortical regions of the brain compared to the midbrain. However, staining in these cortical regions was stronger for TTM-001 and TTM-002 compared to the AAV9 control. It also appeared that the TTM-001 and TTM-002 capsid variants were able to transduce non-neuronal cells, including glial cells and oligodendrocytes. With respect to the spinal cord, staining and payload expression for TTM-01 and TTM-002 were localized to the ventral horns of the grey matter.

Peripheral tissues were also isolated from the mice intravenously injected with the AAV particles encapsulated in the TTM-001 capsid variant or the TTM-002 capsid variant for analysis by qPCR and/or GFP immunohistochemical staining. Transgene mRNA levels and viral genome DNA levels were quantified in the liver by qPCR and the fold over AAV9 was calculated for each capsid variant (Table 12). TTM-001 resulted in similar levels of payload expression (mRNA levels) as compared to wild-type AAV9, but only half as much viral genome DNA was quantified in the liver compared to AAV9. TTM-002 demonstrated greatly reduced mRNA and viral genome DNA levels in the liver compared to AAV9. GFP immunohistochemical staining of the spleen, heart, skeletal muscle, kidneys, and lungs of mice injected with AAV particles encapsulated in the TTM-001 capsid variant or the TTM-002 capsid variant showed similar levels of payload expression as compared to those mice injected with AAV particles encapsulated in the wild-type AAV9 control capsid.

Taken together, these data demonstrate that TTM-001 and TTM-002 are enhanced CNS tropic capsids in mice that can infect non-neuronal cells. Additionally, these capsid variants were able to successfully penetrate the blood brain barrier following intravenous injection.

Example 3. Maturation of TTM-001 and TTM-002 Capsid in Mice

This Example describes maturation of the TTM-001 (SEQ ID NO: 981 (amino acid) and 983 (DNA), comprising SEQ ID NO: 941) and TTM-002 (SEQ ID NO: 982 (amino acid) and 984 (DNA), comprising SEQ ID NO: 2) capsid variants to further enhance their transduction and biodistribution in the central nervous system and evolve the AAV capsid variants to provide further cross-species compatibility. Two approaches were used to mature the TTM-001 and TTM-002 capsid sequences in order to randomize and mutate within and around the peptide insert comprised within loop IV of the capsid variant. As many of the AAV capsid variants that demonstrated the greatest fold-enrichment in the NHP brain relative wild-type AAV9 comprised an SPH motif in the same position (e.g., immediately subsequent to position 455, relative to a reference sequence numbered according to the amino acid sequence of SEQ ID NO: 138) (see Example 1), the SPH motif was not mutated in either approach to mature the TTM-001 and TTM-002 capsid variants. In the first maturation approach, sets of three contiguous amino acids were randomized across the mutagenesis region in the TTM-001 and TTM-002 sequences, which spanned from position 450 to position 466, numbered according to SEQ ID NO: 981 and 982. In the second maturation approach, mutagenic primers were used to introduce point mutations at a low frequency, scattered across the mutagenesis region in the TTM-001 and TTM-002 sequences ranging from position 449 to position 466, numbered according to SEQ ID NO: 981 and 982. AAV capsid variants arising from each maturation approach for TTM-001 were pooled together and AAV capsid variants arising from each maturation approach for TTM-002 were also pooled together, for subsequent testing and characterization in mice.

The library of pooled matured AAV capsid variants generated from TTM-001 or library of pooled matured AAV capsid variants generated from the TTM-002 matured AAV capsid variant each were intravenously injected into the tail vein of three female CD-1 Outbred mice (Charles River) at a dose of $1.0 \times 10^{12}$ VG/dose. After 14-days in life, the brains of the mice were isolated and RNA was extracted. Following RNA recovery and RT-PCR amplification, a systematic NGS enrichment analysis was performed to calculate the fold enrichment ratio relative to the corresponding TTM-001 or TTM-002 control, and the peptides comprised within the variants were identified. The data for the TTM-001 matured capsid variants is provided in Table 13 and the data for the TTM-002 matured capsid variants is provided in Table 14.

As shown in Table 13, approximately 714 TTM-001 matured capsid variants demonstrated at least a 2-fold increase in expression relative to the non-matured TTM-001 control, and several variants demonstrated greater than a four-fold enrichment relative to the non-matured TTM-001 control. Also, across the peptides comprised within the TTM-001 matured capsid variants with the greatest fold-enrichment relative to the non-matured TTM-001 capsid in the brain, it was observed that the modifications in the variant sequences appeared in the region C-terminal to the SPH motif present within the capsid variant. This indicates that modifications that appeared to improve TTM-001 capsid tropism in the CNS of mice were skewed to the C-terminal portion of the peptide insertion in loop IV of the sequence. Additionally, a number of these C-terminal modifications were the incorporation of an arginine (R) or leucine (L) residue.

TABLE 13

NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGSGSPHSLLWNQQT | 1008 | 7.983 |
| KTINGSGSPHSKAQYYVT | 1009 | 6.283 |
| KTINGSGSPHSKLRRQQT | 1010 | 6.231 |
| KTINGSGSPHSIWQNQQT | 1011 | 5.883 |
| KTINGSSSPHCTAQNQQT | 1012 | 5.607 |
| KTINGSGSPHSKAGCGQT | 1013 | 5.341 |
| KSMNGSGSPHSRAQNQQT | 1014 | 5.145 |
| KTINGSGSPHSKRLRQQT | 1015 | 5.034 |
| KTINGSGSPHSLRRNQQT | 1016 | 4.985 |
| KTINGSGSPHSRGRNQQT | 1017 | 4.961 |
| KTINGSGSPHSEIVNQQT | 1018 | 4.931 |
| KTINGSGSPHSSRRNQQT | 1019 | 4.920 |
| KTINGSGSPHCLLQNQQT | 1020 | 4.898 |
| KTIMRVGSPHSKAQNQQT | 1021 | 4.875 |
| KTINGSGSPHSKAFRLQT | 1022 | 4.849 |
| KTINGSGSPHCLAQNQQT | 1023 | 4.847 |

TABLE 13-continued

NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGSCSPHRKAQNQQT | 1024 | 4.801 |
| KTINGSGSPHFLRQNQQT | 1025 | 4.777 |
| KTINGSGSPHSLRFNQQT | 1026 | 4.765 |
| KTINGSGSPHSYLRNQQT | 1027 | 4.566 |
| KTINGSGSPHCSLQNQQT | 1028 | 4.540 |
| KTINGSGSPHVLWQNQQT | 1029 | 4.533 |
| KTINGSGSPHSKWLLQQT | 1030 | 4.521 |
| KTINGSGSPHSLWSNQQT | 1031 | 4.467 |
| KTINGSGSPHSKRRLQQT | 1032 | 4.451 |
| KTINGSGSPHSVYLNQQT | 1033 | 4.426 |
| KTINGSGSPHSLWLNQQT | 1034 | 4.412 |
| KTINGSGSPHSKAQRKLT | 1035 | 4.339 |
| KTINGSGSPHSKALRRQT | 1036 | 4.330 |
| KTINGSGSPHSKAQRLRT | 1037 | 4.322 |
| KYLSGSGSPHSKAQNQQT | 1038 | 4.264 |
| KTINGSGSPHSKAQRRLT | 1039 | 4.227 |
| KTINGSGSPHSKARRQQT | 1040 | 4.218 |
| KTINGSGSPHSKARRLQT | 1041 | 4.210 |
| KTINGSGSPHSKSRRQQT | 1042 | 4.175 |
| KTINGLLSPHWKAQNQQT | 1043 | 4.173 |
| KTINGSGSPHSKARLRQT | 1044 | 4.155 |
| KTINGSGSPHSKASKRQT | 1045 | 4.117 |
| KTINGSGSPHVRRQNQQT | 1046 | 4.114 |
| KTINGSGSPHSKAQLYRT | 1047 | 4.108 |
| KGLSGSGSPHSKAQNQQT | 1048 | 4.056 |
| KTINGSGSPHSLFRNQQT | 1049 | 4.037 |
| KTINGSGSPHSKAQLTVT | 1050 | 4.026 |
| KTINGSRSPHTRAQNQQT | 1051 | 3.989 |
| KTINGSGSPHSKAKLRQT | 1052 | 3.976 |
| KTINGSGSPHSKLIRQQT | 1053 | 3.968 |
| KTINGSGSPHSKALRFQT | 1054 | 3.894 |
| KTINGSGSPHSKRTFQQT | 1055 | 3.879 |
| KTINGSGSPHSKAQKRLT | 1056 | 3.872 |
| KTINGSGSPHLWSQNQQT | 1057 | 3.857 |
| KTINGSGSPHLLWQNQQT | 1058 | 3.855 |
| KTINGSGSPHSRLRNQQT | 1059 | 3.851 |

TABLE 13-continued NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGSGSPHSKRAAQQT | 1060 | 3.838 |
| KTINGSGSPHSKRSWQQT | 1061 | 3.838 |
| KTINGSGSPHSKAQLRRT | 1062 | 3.825 |
| KTINGSGSPHYLVQNQQT | 1063 | 3.819 |
| KTINGSGSPHSKLFRQQT | 1064 | 3.806 |
| KTINGSGSPHSKRAMQQT | 1065 | 3.801 |
| KTINGSGSPHSKTLRQQT | 1066 | 3.788 |
| KTINGSGSPHSRSRNQQT | 1067 | 3.784 |
| KTINGSGSPHRRRQNQQT | 1068 | 3.754 |
| KTINGSGSPHSKTCLQQT | 1069 | 3.717 |
| KTINGSGSPHSKSRWQQT | 1070 | 3.698 |
| KTINGSGSPHRFRQNQQT | 1071 | 3.698 |
| KTINGLRSPHRKAQNQQT | 1072 | 3.676 |
| KTRSRSGSPHSKAQNQQT | 1073 | 3.669 |
| KTINGSGSPHSKAQLVVT | 1074 | 3.654 |
| KTINGSGSPHSRKLNQQT | 1075 | 3.646 |
| KTINGSGSPHSLLCNQQT | 1076 | 3.644 |
| KTINGKRSPHSKAQNQQT | 1077 | 3.611 |
| KTINGSRSPHLFAQNQQT | 1078 | 3.601 |
| KSINGSGSPHSKAHDQQT | 1079 | 3.592 |
| KTINGSGSPHSKAQRSRT | 1080 | 3.585 |
| KTINGSGSPHSTWLNQQT | 1081 | 3.583 |
| KTINGSGSPHSKASRRQT | 1082 | 3.577 |
| KTINGSGSPHSKRSMQQT | 1083 | 3.561 |
| KTINGSGSPHSCLQNQQT | 1084 | 3.559 |
| KTINGSGSPHSKRLWQQT | 1085 | 3.529 |
| KTINGSGSPHSWLSNQQT | 1086 | 3.495 |
| KTINGSGSPHLRRQNQQT | 1087 | 3.493 |
| KTINGSGSPHSKARRSQT | 1088 | 3.493 |
| KTINGSGSPHSKHLRQQT | 1089 | 3.438 |
| KTINGSGSPHSCSQNQQT | 1090 | 3.428 |
| KTINGSGSPHSKSFRQQT | 1091 | 3.426 |
| KTINGSGSPHLCLQNQQT | 1092 | 3.425 |
| KTINGSGSPHSKAQTSRT | 1093 | 3.421 |
| KTINGSGSPHSLCSNQQT | 1094 | 3.413 |
| KTINGSRSPHLRAQNQQT | 1095 | 3.410 |
| KTINGSGSPHSKAQVSKT | 1096 | 3.406 |
| KTINGSGSPHSKAQRHVT | 1097 | 3.404 |
| KTINGSSSPHLCAQNQQT | 1098 | 3.402 |
| KTINGSGSPHSFLRNQQT | 1099 | 3.384 |
| KTINGSGSPHSFVLNQQT | 1100 | 3.382 |
| KTINGSGSPHSKMRAQQT | 1101 | 3.382 |
| KTINGSGSPHRPRQNQQT | 1102 | 3.380 |
| KTINGSGSPHSKCLLQQT | 1103 | 3.374 |
| KTINGSGSPHSKAQSRRT | 1104 | 3.372 |
| KTINGSGSPHSRWQNQQT | 1105 | 3.372 |
| KYSVGSGSPHSKAQNQQT | 1106 | 3.365 |
| KTINGSGSPHSKRFLQQT | 1107 | 3.359 |
| KTINGSGSPHSLFLNQQT | 1108 | 3.358 |
| KTINGSGSPHSKAYLRQT | 1109 | 3.356 |
| KTINGSGSPHSKRNGQQT | 1110 | 3.350 |
| KTINGSGSPHTRRQNQQT | 1111 | 3.350 |
| KTINGSGSPHSKPRLQQT | 1112 | 3.337 |
| KTINFLRSPHSKAQNQQT | 1113 | 3.331 |
| KTINGSGSPHLLCNQQT | 1114 | 3.328 |
| KTINGSGSPHSKARIVQT | 1115 | 3.287 |
| KTINGSKSPHFKAQNQQT | 1116 | 3.285 |
| KTINGSGSPHSKAQIRLT | 1117 | 3.279 |
| KTINGSSSPHWVAQNQQT | 1118 | 3.277 |
| KTINGSGSPHSKATRRQT | 1119 | 3.277 |
| KTINGSLSPHSCAQNQQT | 1120 | 3.268 |
| KTINGSGSPHSLYLNQQT | 1121 | 3.264 |
| KTINGSGSPHSKVGRQQT | 1122 | 3.255 |
| KTINGSGSPHSRRLNQQT | 1123 | 3.251 |
| KTINGSGSPHSKAQHSRT | 1124 | 3.227 |
| KTINGSGSPHSKAFPRQT | 1125 | 3.220 |
| KTINGSPSPHRRAQNQQT | 1126 | 3.216 |
| KTINGSGSPHSKRNLQQT | 1127 | 3.210 |
| KTINGSGSPHSKPTRQQT | 1128 | 3.201 |
| KTINGSGSPHSKLWLQQT | 1129 | 3.199 |
| KTINGSGSPHWLAQNQQT | 1130 | 3.192 |
| KTINGSGSPHRTRQNQQT | 1131 | 3.190 |

TABLE 13-continued

NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGSGSPHSKLNKQQT | 1132 | 3.181 |
| KTINGSGSPHSSLWNQQT | 1133 | 3.179 |
| KTINGSGSPHSKAQITLT | 1134 | 3.177 |
| KTINGSGSPHSKFLFQQT | 1135 | 3.173 |
| KTINGSGSPHSKRTPQQT | 1136 | 3.169 |
| KTINGSGSPHSKAQNSRR | 1137 | 3.168 |
| KTINGSGSPHSRLKNQQT | 1138 | 3.156 |
| KTINGSGSPHSCLLNQQT | 1139 | 3.127 |
| KTINGSGSPHTLYQNQQT | 1140 | 3.117 |
| KTINGSGSPHSKYPSQQT | 1141 | 3.114 |
| KTINGSGSPHSKLRNQQT | 1142 | 3.112 |
| KTINGSGSPHLNWQNQQT | 1143 | 3.112 |
| KTINGVVSPHRKAQNQQT | 1144 | 3.106 |
| KTINGSGSPHSYRPNQQT | 1145 | 3.095 |
| KTINGSTSPHRRAQNQQT | 1146 | 3.089 |
| KTINGSCSPHPLAQNQQT | 1147 | 3.086 |
| KTINGSGSPHSKAFARQT | 1148 | 3.082 |
| KTINGSGSPHSKALRYQT | 1149 | 3.076 |
| KTINGSKSPHRLAQNQQT | 1150 | 3.073 |
| KTINMRVSPHSKAQNQQT | 1151 | 3.073 |
| KTINGSGSPHMYLQNQQT | 1152 | 3.061 |
| KTINGSGSPHSKLARQQT | 1153 | 3.054 |
| KTINGSGSPHSKARPYQT | 1154 | 3.050 |
| KTINGSGSPHSKRVPQQT | 1155 | 3.048 |
| KTINGSGSPHLSWQNQQT | 1156 | 3.047 |
| KTINGRSSPHGKAQNQQT | 1157 | 3.035 |
| KTINGSGSPHLWTQNQQT | 1158 | 3.034 |
| KTINGLLSPHRKAQNQQT | 1159 | 3.026 |
| KTINGSGSPHRLRQNQQT | 1160 | 2.998 |
| KTINGSCSPHSGAQNQQT | 1161 | 2.994 |
| KTINGSGSPHSKAQRRST | 1162 | 2.993 |
| KTINGSGSPHSKLCSQQT | 1163 | 2.989 |
| KTINGSGSPHSKAQLLKT | 1164 | 2.985 |
| KTINGRKSPHSKAQNQQT | 1165 | 2.985 |
| KTINGSGSPHLLYQNQQT | 1166 | 2.983 |
| KTINGSGSPHSKLLRQQT | 1167 | 2.981 |
| KTINGSGSPHSLRHNQQT | 1168 | 2.980 |
| KTINGSGSPHSSKRNQQT | 1169 | 2.978 |
| KTINGSGSPHSKARSRQT | 1170 | 2.972 |
| KTINGRSSPHRKAQNQQT | 1171 | 2.965 |
| KTINGSKSPHRTAQNQQT | 1172 | 2.950 |
| KTINGMRSPHVKAQNQQT | 1173 | 2.937 |
| KTINGSGSPHSKRMSQQT | 1174 | 2.931 |
| KTINGSGSPHSKVPKQQT | 1175 | 2.924 |
| KTINLIRSPHSKAQNQQT | 1176 | 2.920 |
| KTINGSGSPHPFLQNQQT | 1177 | 2.916 |
| KTINGSGSPHSKARLWQT | 1178 | 2.914 |
| KTINGSGSPHSRTRNQQT | 1179 | 2.912 |
| KTINGSGSPHSKRSNQQT | 1180 | 2.886 |
| KTINGSLSPHSWAQNQQT | 1181 | 2.885 |
| KTINGSRSPHYKAQNQQT | 1182 | 2.879 |
| KTINRHSSPHSKAQNQQT | 1183 | 2.877 |
| KTINGSGSPHSKRRNQQT | 1184 | 2.877 |
| KTINGSGSPHSKAKHLQT | 1185 | 2.870 |
| KTINGSGSPHSKRTYQQT | 1186 | 2.870 |
| KTINGVLSPHRKAQNQQT | 1187 | 2.868 |
| KTINGSGSPHSFITNQQT | 1188 | 2.868 |
| KTINGSGSPHSTRLNQQT | 1189 | 2.860 |
| KTINGSGSPHSKRTSQQT | 1190 | 2.857 |
| KTINGSGSPHSRRSNQQT | 1191 | 2.851 |
| KTINGHLSPHRKAQNQQT | 1192 | 2.851 |
| KTINGSGSPHSKAQFSRT | 1193 | 2.847 |
| KTINGSGSPHSKAQTFRT | 1194 | 2.847 |
| KTINGSGSPHSKPLRQQT | 1195 | 2.844 |
| KTINGSGSPHSKASCRQT | 1196 | 2.840 |
| KTINGSGSPHSKILWQQT | 1197 | 2.838 |
| KTINGSGSPHSKALKRQT | 1198 | 2.836 |
| KTINGSGSPHSKAHRSQT | 1199 | 2.819 |
| KTINGSGSPHSMLYNQQT | 1200 | 2.808 |
| KTINGSGSPHSKCTLQQT | 1201 | 2.808 |
| KTINGSGSPHSKAQNRMR | 1202 | 2.804 |
| KTINGSGSPHSKLVRQQT | 1203 | 2.801 |

TABLE 13-continued

NGS fold-enrichment of TTM-001 matured AAV capsid variants in the brain of CD-1 Outbred mice

| Peptide Sequence | SEQ ID NO: | Fold enrichment over TTM-001 |
| --- | --- | --- |
| KTINGSGSPHSKRILQQT | 1204 | 2.801 |
| KTINGSGSPHSKAQWLRT | 1205 | 2.795 |
| KTINGSGSPHSLTCNQQT | 1206 | 2.795 |
| KTINGIRSPHTKAQNQQT | 1207 | 2.793 |
| KTINGSGSPHSKAQRWLT | 1208 | 2.788 |
| KTINGSGSPHSKAQLSIT | 1209 | 2.784 |
| KTINGSGSPHIYRQNQQT | 1210 | 2.782 |
| KTINGSGSPHSLRSNQQT | 1211 | 2.778 |
| KTINGSGSPHSKVKPQQT | 1212 | 2.778 |
| KTINGSGSPHSKATRHQT | 1213 | 2.777 |
| KTINGSLSPHLCAQNQQT | 1214 | 2.775 |
| KTINGSGSPHSKACASQT | 1215 | 2.775 |
| KWSPGSGSPHSKAQNQQT | 1216 | 2.764 |
| KTINGYLSPHRKAQNQQT | 1217 | 2.762 |
| KTINGSGSPHSKVIRQQT | 1218 | 2.760 |
| KTINGSGSPHFLLQNQQT | 1219 | 2.758 |
| KTINGSGSPHSKARSKQT | 1220 | 2.758 |
| KTINGVPSPHWKAQNQQT | 1221 | 2.758 |
| KTINGSGSPHSKATRNQT | 1222 | 2.756 |
| KTINGSGSPHSKACSAQT | 1223 | 2.754 |
| KTINGSGSPHSKARYVQT | 1224 | 2.749 |
| KTINGSRSPHARAQNQQT | 1225 | 2.745 |
| KTINGSGSPHSKAQHLRT | 1226 | 2.741 |
| KTINGSGSPHSKAKSRQT | 1227 | 2.739 |
| KTINGSGSPHSKIGRQQT | 1228 | 2.739 |
| KTINGLASPHRKAQNQQT | 1229 | 2.737 |
| KTINGSGSPHSKARTRQT | 1230 | 2.737 |
| KTINGSGSPHSKSIRQQT | 1231 | 2.728 |
| KTINGSGSPHSKRLYQQT | 1232 | 2.721 |
| KTINGLPSPHRKAQNQQT | 1233 | 2.719 |
| KTINGSLSPHRRAQNQQT | 1234 | 2.717 |
| KTINGKTSPHGKAQNQQT | 1235 | 2.717 |
| KTINGSRSPHRLAQNQQT | 1236 | 2.698 |
| KTINGSGSPHSLTWNQQT | 1237 | 2.698 |
| KTINGSKSPHRKAQNQQT | 1238 | 2.696 |
| KTINGSGSPHSKAQLRKT | 1239 | 2.689 |
| KTINGSGSPHSKSRHQQT | 1240 | 2.685 |
| KTINRRLSPHSKAQNQQT | 1241 | 2.678 |
| KTINGSGSPHSRRVNQQT | 1242 | 2.676 |
| KTINGSGSPHSHWQNQQT | 1243 | 2.676 |
| KTTHCSGSPHSKAQNQQT | 1244 | 2.672 |
| KTINGSGSPHSWLQNQQT | 1245 | 2.665 |
| KTINGSTSPHYLAQNQQT | 1246 | 2.665 |
| KTINGLTSPHRKAQNQQT | 1247 | 2.663 |
| KTINGSGSPHSKRLLQQT | 1248 | 2.659 |
| KTINGSGSPHSKLCVQQT | 1249 | 2.659 |
| KTINGFLSPHRKAQNQQT | 1250 | 2.654 |
| KTINGSGSPHSKMRPQQT | 1251 | 2.652 |
| KTINGSGSPHSKQTRQQT | 1252 | 2.650 |
| KTINGSGSPHSYLINQQT | 1253 | 2.650 |
| KTINGSGSPHSKALRSQT | 1254 | 2.648 |
| KTINGMLSPHRKAQNQQT | 1255 | 2.646 |
| KTINGSGSPHSKCLTQQT | 1256 | 2.644 |
| KTINGSGSPHSKAQLTLT | 1257 | 2.641 |
| KTINGHSSPHRKAQNQQT | 1258 | 2.639 |
| KTINGSGSPHLTWQNQQT | 1259 | 2.637 |
| KTINGSGSPHSKAQYCLT | 1260 | 2.628 |
| KTINGSGSPHSFLVNQQT | 1261 | 2.624 |
| KTINMSRSPHSKAQNQQT | 1262 | 2.622 |
| KTINGSGSPHSKAQLHRT | 1263 | 2.618 |
| KTINGSGSPHLYMQNQQT | 1264 | 2.615 |
| KTINGSRSPHRRAQNQQT | 1265 | 2.615 |
| KTINGSGSPHSKAQNRRS | 1266 | 2.613 |
| KTINLRFSPHSKAQNQQT | 1267 | 2.611 |
| KTINGSGSPHSKAQRLWT | 1268 | 2.611 |
| KTINGSGSPHSKGRAQQT | 1269 | 2.607 |
| KTINGSGSPHSLSCNQQT | 1270 | 2.605 |
| KTINGLVSPHCKAQNQQT | 1271 | 2.605 |
| KTINGSSSPHLWAQNQQT | 1272 | 2.605 |
| KTINGSGSPHSKAHRLQT | 1273 | 2.603 |
| KTINGSGSPHPYAQNQQT | 1274 | 2.598 |
| KTINGSGSPHSTRPNQQT | 1275 | 2.598 |

TABLE 13-continued

NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGRSSPHPKAQNQQT | 1276 | 2.596 |
| KTINGSGSPHSKAQSWRT | 1277 | 2.596 |
| KTINGQRSPHVKAQNQQT | 1278 | 2.596 |
| KTINGSGSPHSKAQFVRT | 1279 | 2.596 |
| KTINGSGSPHSKCLNQQT | 1280 | 2.594 |
| KTINGSGSPHSSLCNQQT | 1281 | 2.592 |
| KTINGQRSPHSKAQNQQT | 1282 | 2.590 |
| KTINGSGSPHSLSWNQQT | 1283 | 2.588 |
| KTINGSGSPHSSRKNQQT | 1284 | 2.585 |
| KTINGSGSPHSKRTLQQT | 1285 | 2.583 |
| KTINGSLSPHCLAQNQQT | 1286 | 2.577 |
| KTINGSGSPHSKAQSSRT | 1287 | 2.575 |
| KTINGSGSPHLKRQNQQT | 1288 | 2.564 |
| KTINGSGSPHSKARMGQT | 1289 | 2.564 |
| KTINGSGSPHSKAQVKLT | 1290 | 2.564 |
| KTINGSGSPHSKLPRQQT | 1291 | 2.562 |
| KTINGSGSPHSKLCLQQT | 1292 | 2.562 |
| KTINGSGSPHSPLWNQQT | 1293 | 2.562 |
| KTINGSVSPHSWAQNQQT | 1294 | 2.562 |
| KTIRSKGSPHSKAQNQQT | 1295 | 2.559 |
| KTINGSRSPHSWAQNQQT | 1296 | 2.559 |
| KTINGSGSPHSKILRQQT | 1297 | 2.557 |
| KTINGRQSPHVKAQNQQT | 1298 | 2.557 |
| KTINGSGSPHSKAQSIKT | 1299 | 2.555 |
| KTINGSGSPHSKAQASKT | 1300 | 2.546 |
| KTINGSGSPHSRLFNQQT | 1301 | 2.542 |
| KTINGSGSPHIYLQNQQT | 1302 | 2.542 |
| KTINGSGSPHSRVRNQQT | 1303 | 2.540 |
| KTINGSGSPHSKAVRAQT | 1304 | 2.538 |
| KTINGSGSPHSKPARQQT | 1305 | 2.538 |
| KTINGSGSPHSRYSNQQT | 1306 | 2.536 |
| KTINGSRSPHRSAQNQQT | 1307 | 2.536 |
| KTINGSLSPHIYAQNQQT | 1308 | 2.536 |
| KTINGSGSPHSKPVRQQT | 1309 | 2.529 |
| KTINGMRSPHGKAQNQQT | 1310 | 2.527 |
| KTINGSGSPHSKARITQT | 1311 | 2.525 |
| KTINGSGSPHSWSLNQQT | 1312 | 2.523 |
| KTINTSRSPHSKAQNQQT | 1313 | 2.520 |
| KTINGSGSPHSKAFTRQT | 1314 | 2.518 |
| KTINGSGSPHSKAVRNQT | 1315 | 2.516 |
| KTINGSGSPHSKAQTNRT | 1316 | 2.510 |
| KTINGSGSPHSKANRMQT | 1317 | 2.508 |
| KTINGSGSPHSKAQLVLT | 1318 | 2.508 |
| KTINGSGSPHSKATRQQT | 1319 | 2.505 |
| KTINGSGSPHSKARGTQT | 1320 | 2.505 |
| KTINGSGSPHSKAQWSVT | 1321 | 2.501 |
| KTINGSGSPHSKAWLIQT | 1322 | 2.499 |
| KTINGSGSPHSKAFRPQT | 1323 | 2.499 |
| KTINGSGSPHRRSQNQQT | 1324 | 2.497 |
| KTINGSGSPHSKGIRQQT | 1325 | 2.497 |
| KTINGSGSPHCTLQNQQT | 1326 | 2.497 |
| KPLPGSGSPHSKAQNQQT | 1327 | 2.495 |
| KTINGSGSPHLVCQNQQT | 1328 | 2.493 |
| KTINGSGSPHSKARGYQT | 1329 | 2.492 |
| KTINGRISPHGKAQNQQT | 1330 | 2.492 |
| KTINGSSSPHWLAQNQQT | 1331 | 2.490 |
| KTINGSGSPHSKARMAQT | 1332 | 2.488 |
| KPLDGSGSPHSKAQNQQT | 1333 | 2.488 |
| KPLRGSGSPHSKAQNQQT | 1334 | 2.486 |
| KTINGSGSPHSKAQNAKL | 1335 | 2.486 |
| KTINGSGSPHSKLSKQQT | 1336 | 2.482 |
| KTINGSGSPHSKARNGQT | 1337 | 2.482 |
| KTINGSGSPHSKAQRRQT | 1338 | 2.479 |
| KTINGSGSPHSKWPGQQT | 1339 | 2.477 |
| KTINGSGSPHAFLQNQQT | 1340 | 2.475 |
| KTINGILSPHRKAQNQQT | 1341 | 2.475 |
| KTINGSGSPHSWGSNQQT | 1342 | 2.473 |
| KTINGSGSPHSSCLNQQT | 1343 | 2.471 |
| KTINGSGSPHSKAQSVKT | 1344 | 2.464 |
| KTINGSGSPHSLRYNQQT | 1345 | 2.462 |
| KTINGSGSPHSKARKLQT | 1346 | 2.458 |
| KHRSGSGSPHSKAQNQQT | 1347 | 2.456 |

TABLE 13-continued

NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGSGSPHSKWSLQQT | 1348 | 2.453 |
| KTINGSGSPHSKAQTMRT | 1349 | 2.453 |
| KTINGSGSPHSKTIRQQT | 1350 | 2.453 |
| KTINGKLSPHMKAQNQQT | 1351 | 2.449 |
| KTINGSGSPHSKARPFQT | 1352 | 2.443 |
| KTINGSGSPHSKPRVQQT | 1353 | 2.441 |
| KTINGSGSPHSKAQVVLT | 1354 | 2.438 |
| KTRRSSGSPHSKAQNQQT | 1355 | 2.438 |
| KTINGSGSPHSKPSRQQT | 1356 | 2.438 |
| KTINGSGSPHSVYRNQQT | 1357 | 2.432 |
| KTINGSGSPHSKTCSQQT | 1358 | 2.430 |
| KTINGSPSPHRKAQNQQT | 1359 | 2.430 |
| KTINGRSSPHFKAQNQQT | 1360 | 2.428 |
| KTINGSGSPHSKAQMVRT | 1361 | 2.426 |
| KTINGSRSPHCSAQNQQT | 1362 | 2.426 |
| KTINGSCSPHLRAQNQQT | 1363 | 2.423 |
| KTINGSGSPHSKAQCLFT | 1364 | 2.421 |
| KTINGRPSPHVKAQNQQT | 1365 | 2.419 |
| KTINGSGSPHSMFPNQQT | 1366 | 2.419 |
| KTINGMKSPHSKAQNQQT | 1367 | 2.413 |
| KTINGSGSPHSKVRAQQT | 1368 | 2.412 |
| KGLVGSGSPHSKAQNQQT | 1369 | 2.412 |
| KTINGSRSPHVRAQNQQT | 1370 | 2.412 |
| KTIRLRGSPHSKAQNQQT | 1371 | 2.408 |
| KPRLGSGSPHSKAQNQQT | 1372 | 2.406 |
| KTINGSGSPHSKAWYPQT | 1373 | 2.406 |
| KTINGSCSPHVRAQNQQT | 1374 | 2.406 |
| KTINGSGSPHSKRNVQQT | 1375 | 2.404 |
| KTINGSGSPHSKRGLQQT | 1376 | 2.402 |
| KTINGSGSPHSKRLAQQT | 1377 | 2.397 |
| KTINGSGSPHSKVTRQQT | 1378 | 2.397 |
| KTINGSGSPHTWLQNQQT | 1379 | 2.397 |
| KTINGSGSPHSKQRSQQT | 1380 | 2.395 |
| KTINGSGSPHSKAQRCST | 1381 | 2.393 |
| KTINGSPSPHYLAQNQQT | 1382 | 2.391 |
| KTINGRRSPHLKAQNQQT | 1383 | 2.391 |
| KTINGSGSPHWSLQNQQT | 1384 | 2.389 |
| KTINGVTSPHWKAQNQQT | 1385 | 2.387 |
| KTINGSGSPHSKAQTTRT | 1386 | 2.385 |
| KTINGSGSPHSKAQLFKT | 1387 | 2.385 |
| KTINGSGSPHSKARSYQT | 1388 | 2.382 |
| KTINGSGSPHSKLSRQQT | 1389 | 2.380 |
| KTINGSGSPHLVFQNQQT | 1390 | 2.376 |
| KTINGSGSPHSKAQLVKT | 1391 | 2.376 |
| KTINGSGSPHSKAQTGRT | 1392 | 2.371 |
| KTINGSGSPHSKARYSQT | 1393 | 2.369 |
| KTINGRHSPHLKAQNQQT | 1394 | 2.369 |
| KTINGSGSPHSFARNQQT | 1395 | 2.367 |
| KTINGSGSPHSSCQNQQT | 1396 | 2.365 |
| KTINGSGSPHSLFANQQT | 1397 | 2.365 |
| KTINGSGSPHSKRLTQQT | 1398 | 2.363 |
| KTINGSGSPHSKAQTART | 1399 | 2.363 |
| KTINGSGSPHFLNQQQT | 1400 | 2.359 |
| KTINGSGSPHSKAQLILT | 1401 | 2.358 |
| KEVGGSGSPHSKAQNQQT | 1402 | 2.358 |
| KTINGSRSPHIRAQNQQT | 1403 | 2.356 |
| KTINGSGSPHSSWLNQQT | 1404 | 2.354 |
| KTINGSMSPHLYAQNQQT | 1405 | 2.354 |
| KTINGMSSPHRKAQNQQT | 1406 | 2.352 |
| KTINGSGSPHSKPRPQQT | 1407 | 2.352 |
| KTINGSGSPHSGLWNQQT | 1408 | 2.350 |
| KTINGSGSPHRWAQNQQT | 1409 | 2.350 |
| KTINGSGSPHSKIRLQQT | 1410 | 2.348 |
| KTINGSGSPHSKFSCQQT | 1411 | 2.348 |
| KTINGSGSPHSKSCAQQT | 1412 | 2.348 |
| KTINGSGSPHSKRLMQQT | 1413 | 2.345 |
| KTSRCSGSPHSKAQNQQT | 1414 | 2.345 |
| KTINGSGSPHSFLLNQQT | 1415 | 2.341 |
| KTINGSGSPHCSAQNQQT | 1416 | 2.339 |
| KTINGSGSPHSKAQPSKT | 1417 | 2.339 |
| KTINGSGSPHSYVRNQQT | 1418 | 2.339 |
| KTINGSGSPHSKAQQSRT | 1419 | 2.337 |

TABLE 13-continued

NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGSGSPHSFVVNQQT | 1420 | 2.335 |
| KTINGFRSPHSKAQNQQT | 1421 | 2.333 |
| KTINGSGSPHSKWLVQQT | 1422 | 2.333 |
| KTINGSGSPHSKRTAQQT | 1423 | 2.331 |
| KTINGLFSPHRKAQNQQT | 1424 | 2.331 |
| KTINTIESPHSKAQNQQT | 1425 | 2.331 |
| KRLFGSGSPHSKAQNQQT | 1426 | 2.330 |
| KTINGSGSPHSKAPNHLT | 1427 | 2.324 |
| KTINGSGSPHLFRQNQQT | 1428 | 2.324 |
| KTINGSGSPHSKASRHQT | 1429 | 2.324 |
| KTINGSGSPHSKLSWQQT | 1430 | 2.322 |
| KETAGSGSPHSKAQNQQT | 1431 | 2.320 |
| KTINGHRSPHLKAQNQQT | 1432 | 2.320 |
| KTINGSGSPHSKGCLQQT | 1433 | 2.320 |
| KTINGSGSPHSKAQVLIT | 1434 | 2.317 |
| KTINGSGSPHSKLRSQQT | 1435 | 2.309 |
| KTINGTLSPHRKAQNQQT | 1436 | 2.307 |
| KTINGSGSPHSTWTNQQT | 1437 | 2.307 |
| KTINGSGSPHSKAQCRLT | 1438 | 2.304 |
| KTINNLRSPHSKAQNQQT | 1439 | 2.302 |
| KTINGSGSPHSKARANQT | 1440 | 2.300 |
| KTINGRQSPHTKAQNQQT | 1441 | 2.294 |
| KTINSARSPHSKAQNQQT | 1442 | 2.292 |
| KTINGCSSPHRKAQNQQT | 1443 | 2.291 |
| KTINGSVSPHFMAQNQQT | 1444 | 2.287 |
| KTINGSGSPHSLCQNQQT | 1445 | 2.285 |
| KTINGSLSPHLFAQNQQT | 1446 | 2.285 |
| KTINGSGSPHSKACPLQT | 1447 | 2.285 |
| KTINGRTSPHRKAQNQQT | 1448 | 2.285 |
| KTINGSGSPHSKRATQQT | 1449 | 2.283 |
| KTINGSGSPHSKARIMQT | 1450 | 2.283 |
| KTINGSGSPHVTWQNQQT | 1451 | 2.281 |
| KTINGSGSPHSKRLPQQT | 1452 | 2.279 |
| KTINGSGSPHSKAQGERT | 1453 | 2.279 |
| KTINGSGSPHLYGQNQQT | 1454 | 2.277 |
| KTINGSGSPHLSCQNQQT | 1455 | 2.277 |
| KTINGSGSPHSKAQFTLT | 1456 | 2.277 |
| KTINGSRSPHFKAQNQQT | 1457 | 2.277 |
| KTINGRPSPHSKAQNQQT | 1458 | 2.276 |
| KTINGFSSPHRKAQNQQT | 1459 | 2.276 |
| KTINGRASPHVKAQNQQT | 1460 | 2.272 |
| KTINGSGSPHSKAQNEVH | 1461 | 2.272 |
| KTINGSGSPHSKRSLQQT | 1462 | 2.270 |
| KTINGSGSPHRSRQNQQT | 1463 | 2.270 |
| KPPTGSGSPHSKAQNQQT | 1464 | 2.270 |
| KTINGSGSPHSKAARTQT | 1465 | 2.266 |
| KTINGSGSPHSSWANQQT | 1466 | 2.264 |
| KTINGSGSPHSKAQRHAT | 1467 | 2.264 |
| KTINSPRSPHSKAQNQQT | 1468 | 2.264 |
| KTINGSGSPHSKSERQQT | 1469 | 2.263 |
| KTINGSGSPHALFQNQQT | 1470 | 2.261 |
| KTINGSGSPHSKAQCYVT | 1471 | 2.261 |
| KTINGVASPHRKAQNQQT | 1472 | 2.261 |
| KTINGSGSPHSALWNQQT | 1473 | 2.261 |
| KTINGSGSPHSKSVRQQT | 1474 | 2.259 |
| KTINGSGSPHSHMENQQT | 1475 | 2.259 |
| KTINGSGTPHSKAQNQQT | 1476 | 2.259 |
| KTINGSGSPHSKTGRQQT | 1477 | 2.259 |
| KTINGSGSPHSKAQANRT | 1478 | 2.255 |
| KTINGSGSPHSKARFSQT | 1479 | 2.253 |
| KYLLGSGSPHSKAQNQQT | 1480 | 2.253 |
| KTINGSGSPHCSSQNQQT | 1481 | 2.253 |
| KTINGSMSPHRKAQNQQT | 1482 | 2.251 |
| KTINGNLSPHRKAQNQQT | 1483 | 2.250 |
| KEVAGSGSPHSKAQNQQT | 1484 | 2.250 |
| KTINLSRSPHSKAQNQQT | 1485 | 2.246 |
| KTINGSGSPHSKARQQQT | 1486 | 2.244 |
| KTINGTPSPHRKAQNQQT | 1487 | 2.244 |
| KTINGSGSPHSKFKLQQT | 1488 | 2.244 |
| KTINGSGSPHSKAWLLQT | 1489 | 2.240 |
| KTINGLRSPHSKAQNQQT | 1490 | 2.238 |
| KTINGRLSPHRKAQNQQT | 1491 | 2.238 |

TABLE 13-continued

NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGSPSPHLFAQNQQT | 1492 | 2.238 |
| KDLRGSGSPHSKAQNQQT | 1493 | 2.238 |
| KTINGSGSPHSKAQLAKT | 1494 | 2.238 |
| KTINGSGSPHSKPRSQQT | 1495 | 2.235 |
| KTINGSGSPHSKKMSQQT | 1496 | 2.235 |
| KTINGSGSPHSKAQLIVT | 1497 | 2.235 |
| KTINGSGSPHSKARFTQT | 1498 | 2.233 |
| KTINGSGSPHPLFQNQQT | 1499 | 2.233 |
| KTINGSGSPHSKAQRGMT | 1500 | 2.231 |
| KTINGSGSPHSKAQNLRR | 1501 | 2.231 |
| KTINGSGSPHSKAQFRVT | 1502 | 2.231 |
| KTINGSGSPHSKAFVRQT | 1503 | 2.225 |
| KTINGSGSPHSKARLTQT | 1504 | 2.223 |
| KTINGSGSPHRFKQNQQT | 1505 | 2.223 |
| KTINGSGSPHSKEETQQT | 1506 | 2.223 |
| KTINGSGSPHSKTRAQQT | 1507 | 2.223 |
| KTINGSGSPHSVSWNQQT | 1508 | 2.223 |
| KTINGSGSPHTKWQNQQT | 1509 | 2.222 |
| KTINGSNSPHRKAQNQQT | 1510 | 2.218 |
| KTINGSGSPHSKAQNKRS | 1511 | 2.214 |
| KTINGSGSPHSTRQNQQT | 1512 | 2.212 |
| KTINGTRSPHTKAQNQQT | 1513 | 2.203 |
| KTINGSGSPHVLFQNQQT | 1514 | 2.203 |
| KTINGSVSPHYLAQNQQT | 1515 | 2.203 |
| KTINGALSPHRKAQNQQT | 1516 | 2.203 |
| KTINGSGSPHSKARLYQT | 1517 | 2.201 |
| KTINGSGSPHEHNQNQQT | 1518 | 2.199 |
| KTINGVLSPHWKAQNQQT | 1519 | 2.199 |
| KTINGSGSPHSKASRQQT | 1520 | 2.197 |
| KTINGSGSPHSKRSFQQT | 1521 | 2.197 |
| KTINGSGSPHSKRVSQQT | 1522 | 2.196 |
| KTINGSGSPHSYSRNQQT | 1523 | 2.196 |
| KTINGSGSPHSTVWNQQT | 1524 | 2.196 |
| KTINGSGSPHSVLFNQQT | 1525 | 2.194 |
| KTINGPLSPHCKAQNQQT | 1526 | 2.194 |
| KTINGSGSPHSKRVGQQT | 1527 | 2.190 |
| KTINGSGSPHSKLWSQQT | 1528 | 2.190 |
| KTINGSGSPHSKAQGVRT | 1529 | 2.188 |
| KTINGSVSPHRRAQNQQT | 1530 | 2.186 |
| KTINGSGSPHLRFQNQQT | 1531 | 2.186 |
| KTINGSASPHVFAQNQQT | 1532 | 2.186 |
| KTWVRSGSPHSKAQNQQT | 1533 | 2.186 |
| KTINGSGSPHSKARMQQT | 1534 | 2.184 |
| KTINGSGSPHSKASRGQT | 1535 | 2.182 |
| KTINGSGSPHSKAQVCLT | 1536 | 2.182 |
| KTINGSGSPHSKARGVQT | 1537 | 2.181 |
| KTINGSGSPHGLWQNQQT | 1538 | 2.181 |
| KTINGSGSPHSKAQVWFT | 1539 | 2.181 |
| KTINGSGSPHSKAQVTLT | 1540 | 2.179 |
| KTINGSGSPHSKAQLRIT | 1541 | 2.179 |
| KDSLGSGSPHSKAQNQQT | 1542 | 2.175 |
| KTINGSGSPHSKRASQQT | 1543 | 2.173 |
| KTINGSGSPHSKRINQQT | 1544 | 2.173 |
| KTINGSGSPHSKASKNQT | 1545 | 2.171 |
| KTINGSGSPHSKAQLPWT | 1546 | 2.169 |
| KTINGSGSPHSKLTRQQT | 1547 | 2.169 |
| KTINGSGSPHSKINRQQT | 1548 | 2.169 |
| KTINRVISPHSKAQNQQT | 1549 | 2.169 |
| KTINGSGSPHTLWQNQQT | 1550 | 2.168 |
| KTINGSGSPHSRRQNQQT | 1551 | 2.166 |
| KTINGSGSPHSKGGRQQT | 1552 | 2.164 |
| KTINGSESPHDSAQNQQT | 1553 | 2.164 |
| KTINGSGSPHSRPRNQQT | 1554 | 2.164 |
| KTINGSGSPHSRKQNQQT | 1555 | 2.162 |
| KTINGSGSPHSKAQEELT | 1556 | 2.162 |
| KTINGWRSPHSKAQNQQT | 1557 | 2.160 |
| KTINGSGSPHSLLYNQQT | 1558 | 2.158 |
| KTINGSGSPHSFRLNQQT | 1559 | 2.158 |
| KTINGSGSPHSKAQFLRT | 1560 | 2.156 |
| KTINGSGSPHSKQSRQQT | 1561 | 2.156 |
| KTINGSRSPHSKAQNRQT | 1562 | 2.155 |
| KTINGRPSPHIKAQNQQT | 1563 | 2.155 |

TABLE 13-continued

NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGSGSPHSKRLVQQT | 1564 | 2.151 |
| KGHEGSGSPHSKAQNQQT | 1565 | 2.151 |
| KTINGSGSPHSKAQKRST | 1566 | 2.151 |
| KTINGSGSPHSYLLNQQT | 1567 | 2.147 |
| KTINGSGSPHSKPRGQQT | 1568 | 2.147 |
| KTINGSGSPHSKTRLQQT | 1569 | 2.145 |
| KTINGSGSPHSKSHRQQT | 1570 | 2.145 |
| KEIKGSGSPHSKAQNQQT | 1571 | 2.140 |
| KTINGSGSPHSKARGIQT | 1572 | 2.140 |
| KTINGYRSPHSKAQNQQT | 1573 | 2.140 |
| KTINGSGSPHSKLWTQQT | 1574 | 2.140 |
| KTINGSGSPHSKPWLQQT | 1575 | 2.138 |
| KTINGSGSPHWSVQNQQT | 1576 | 2.138 |
| KTINGSGSPHSKVARQQT | 1577 | 2.136 |
| KTINGSGSPHTLFQNQQT | 1578 | 2.136 |
| KTINGSCSPHLAAQNQQT | 1579 | 2.134 |
| KTINGSGSPHSKTSRQQT | 1580 | 2.132 |
| KTINGSGSPHSKAQNARH | 1581 | 2.127 |
| KTINGSGSPHSKAQLKLT | 1582 | 2.125 |
| KTINGSGSPHSKAQNWRT | 1583 | 2.125 |
| KTINGSGSPHELPQNQQT | 1584 | 2.123 |
| KTINGSGSPHSKNVRQQT | 1585 | 2.123 |
| KTINGSGSPHFMRQNQQT | 1586 | 2.123 |
| KTINGSGSPHGWAQNQQT | 1587 | 2.121 |
| KTINGSGSPHFHLQNQQT | 1588 | 2.121 |
| KTINGSASPHWSAQNQQT | 1589 | 2.121 |
| KTINGSSSPHSWAQNQQT | 1590 | 2.119 |
| KTINGSGSPHSKAHRQQT | 1591 | 2.117 |
| KTINGSGSPHSKQRVQQT | 1592 | 2.117 |
| KTLRRSGSPHSKAQNQQT | 1593 | 2.117 |
| KTINGSGSPHSKGVRQQT | 1594 | 2.115 |
| KTINGSLSPHTWAQNQQT | 1595 | 2.115 |
| KTINGSGSPHSKRALQQT | 1596 | 2.114 |
| KTINGSGSPHCLSQNQQT | 1597 | 2.114 |
| KTINGSGSPHSKAQSLKT | 1598 | 2.110 |
| KTINGSGSPHSFVRNQQT | 1599 | 2.110 |
| KTINGSGSPHSIFSNQQT | 1600 | 2.110 |
| KTINGSGSPHSKVSRQQT | 1601 | 2.108 |
| KTINGSGSPHSKARNKQT | 1602 | 2.108 |
| KTINASGSPHSKAQGQQT | 1603 | 2.108 |
| KTINGSGSPHSKLRMQQT | 1604 | 2.106 |
| KTINGSWSPHMLAQNQQT | 1605 | 2.106 |
| KTINGSGSPHSLFPNQQT | 1606 | 2.106 |
| KPPLGSGSPHSKAQNQQT | 1607 | 2.102 |
| KTINGIASPHRKAQNQQT | 1608 | 2.099 |
| KTINGSCSPHSLAQNQQT | 1609 | 2.099 |
| KTINGRLSPHFKAQNQQT | 1610 | 2.097 |
| KTINGSGSPHSKARMTQT | 1611 | 2.091 |
| KTINGSGSPHSKARLQQT | 1612 | 2.089 |
| KTINGSGSPHSKWVSQQT | 1613 | 2.089 |
| KTINGSGSPHSKKVSQQT | 1614 | 2.088 |
| KTINGSGSPHSKAQSYRT | 1615 | 2.088 |
| KAFNGSGSPHSKAPNQQT | 1616 | 2.088 |
| KTINGSGSPHSKAQYRLT | 1617 | 2.088 |
| KTINGSWSPHLVAQNQQT | 1618 | 2.084 |
| KTINGSGSPHSWTQNQQT | 1619 | 2.084 |
| KTINGSGSPHSKAQSHRT | 1620 | 2.084 |
| KGINGSGSPHGKAQNQQT | 1621 | 2.084 |
| KTINGSGSPHSKAQNRKL | 1622 | 2.084 |
| KTINGRYSPHSKAQNQQT | 1623 | 2.080 |
| KTINGSGSPHSKGRSQQT | 1624 | 2.080 |
| KTINGSGSPHCVAQNQQT | 1625 | 2.080 |
| KTINGSGSPHSKIRPQQT | 1626 | 2.080 |
| KTINGSGSPHSKAQSSKT | 1627 | 2.078 |
| KTINGSGSPHSKRPFQQT | 1628 | 2.076 |
| KTINGSSSPHCLAQNQQT | 1629 | 2.074 |
| KTINGTRSPHAKAQNQQT | 1630 | 2.071 |
| KTINGSGSPHLLFQNQQT | 1631 | 2.069 |
| KTINGRRSPHTKAQNQQT | 1632 | 2.069 |
| KTINGSGSPHSKASKQQT | 1633 | 2.069 |
| KTINGSGSPHSKAQLGRT | 1634 | 2.069 |
| KTINGSGSPHSVFLNQQT | 1635 | 2.069 |

TABLE 13-continued

NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGSGSPHSKSARQQT | 1636 | 2.067 |
| KTINGSGSPHSKLRLQQT | 1637 | 2.065 |
| KTRKSSGSPHSKAQNQQT | 1638 | 2.065 |
| KTINGFRSPHLKAQNQQT | 1639 | 2.063 |
| KTINGSGSPHSKRSIQQT | 1640 | 2.063 |
| KTINGSGSPHSKGRIQQT | 1641 | 2.061 |
| KTINGSRSPHRPAQNQQT | 1642 | 2.061 |
| KTINGSGSPHSKLRPQQT | 1643 | 2.060 |
| KTINGSGSPHMYAQNQQT | 1644 | 2.060 |
| KTINGRTSPHAKAQNQQT | 1645 | 2.060 |
| KTINGSGSPHSKAGRGQT | 1646 | 2.058 |
| KTINGSGSPHSKLMRQQT | 1647 | 2.056 |
| KTINGSGSPHSKANKSQT | 1648 | 2.056 |
| KTINGSGSPHSKAVRQQT | 1649 | 2.052 |
| KTINGSGSPHSKCLSQQT | 1650 | 2.052 |
| KTINGSGSPHSKAQWVLT | 1651 | 2.052 |
| KTINGSGSPHSKAQFWVT | 1652 | 2.050 |
| KTINGSGSPHSKALCRQT | 1653 | 2.048 |
| KEVMGSGSPHSKAQNQQT | 1654 | 2.047 |
| KTINGSGSPHSKNTRQQT | 1655 | 2.047 |
| KTINGSGSPHTWTQNQQT | 1656 | 2.045 |
| KTINGSTSPHWSAQNQQT | 1657 | 2.043 |
| KTINGNVSPHRKAQNQQT | 1658 | 2.043 |
| KTINGSTSPHLFAQNQQT | 1659 | 2.041 |
| KTINGSGSPHSKAQNYRA | 1660 | 2.039 |
| KTINGSGSPHSKARGQQT | 1661 | 2.039 |
| KTINGSGSPHSKAQNRIR | 1662 | 2.039 |
| KTINGSGSPHSKWTLQQT | 1663 | 2.039 |
| KTINGSGSPHSKAQMKCT | 1664 | 2.039 |
| KTINGSGSPHSLWQNQQT | 1665 | 2.037 |
| KTINGSGSPHSKAQLSKT | 1666 | 2.035 |
| KTINLIWSPHSKAQNQQT | 1667 | 2.035 |
| KTINGSGSPHSKRVLQQT | 1668 | 2.035 |
| KTINGSGSPHSKVRVQQT | 1669 | 2.034 |
| KTINSRFSPHSKAQNQQT | 1670 | 2.032 |
| KRSKGSGSPHSKAQNQQT | 1671 | 2.030 |
| KTINGSGSPHRRLQNQQT | 1672 | 2.030 |
| KTINGSGSPHSCAQNQQT | 1673 | 2.030 |
| KTINGPLSPHRKAQNQQT | 1674 | 2.028 |
| KTINGSVSPHLYAQNQQT | 1675 | 2.028 |
| KTINGRISPHLKAQNQQT | 1676 | 2.028 |
| KTINGSHSPHRKAQNQQT | 1677 | 2.028 |
| KTINGSGSPHSKAQVSIT | 1678 | 2.028 |
| KTINGSMSPHRRAQNQQT | 1679 | 2.028 |
| KTINGRQSPHAKAQNQQT | 1680 | 2.026 |
| KTINGSGSPHSKAVWRQT | 1681 | 2.026 |
| KQPLGSGSPHSKAQNQQT | 1682 | 2.024 |
| KTINGSGSPHSKAQNVKL | 1683 | 2.024 |
| KTINGSGSPHSKRGTQQT | 1684 | 2.022 |
| KTINGSVSPHYVAQNQQT | 1685 | 2.022 |
| KTINGSGSPHSKNLRQQT | 1686 | 2.022 |
| KTINGSGSPHSKAQAFRT | 1687 | 2.022 |
| KTINGSGSPHSKCSNQQT | 1688 | 2.020 |
| KELVGSGSPHSKAQNQQT | 1689 | 2.019 |
| KTINGSGSPHSLVFNQQT | 1690 | 2.019 |
| KTINGSGSPHSKAQATRT | 1691 | 2.019 |
| KTINGTSSPHCKAQNQQT | 1692 | 2.017 |
| KTINGSGSPHSKALWRQT | 1693 | 2.015 |
| KTINGSGSPHSKAQFSVT | 1694 | 2.015 |
| KTINGSGSPHSKLYMQQT | 1695 | 2.015 |
| KTINGSLSPHYMAQNQQT | 1696 | 2.015 |
| KTINGSGSPHSKAWLMQT | 1697 | 2.015 |
| KTINGSGSPHSKSLKQQT | 1698 | 2.013 |
| KTINGSGSPHSKAQNTRR | 1699 | 2.013 |
| KTINGSGSPHYLLQNQQT | 1700 | 2.011 |
| KTINGSGSPHTWSQNQQT | 1701 | 2.011 |
| KTINGSGSPHSKTRMQQT | 1702 | 2.011 |
| KTINTRPSPHSKAQNQQT | 1703 | 2.011 |
| KTINGSGSPHSKAQILVT | 1704 | 2.009 |
| KTINGSGSPHSKAQNAKS | 1705 | 2.009 |
| KTINGSGSPHSRTYNQQT | 1706 | 2.009 |
| KTINGSGSPHSKKGGQQT | 1707 | 2.009 |

TABLE 13-continued

NGS fold-enrichment of TTM-001 matured AAV capsid variants in the brain of CD-1 Outbred mice

| Peptide Sequence | SEQ ID NO: | Fold enrichment over TTM-001 |
|---|---|---|
| KTINGYSSPHRKAQNQQT | 1708 | 2.007 |
| KTINGSGSPHWVSQNQQT | 1709 | 2.007 |
| KTINGSGSPHSKARLAQT | 1710 | 2.007 |
| KTINGMCSPHSKAQNQQT | 1711 | 2.006 |
| KTINGSGSPHSKSNKQQT | 1712 | 2.006 |
| KTINGSGSPHSKAQFVLT | 1713 | 2.006 |
| KTINGSISPHFVAQNQQT | 1714 | 2.006 |
| KTINGSGSPHRRMQNQQT | 1715 | 2.004 |
| KTINGSGSPHSKAWILQT | 1716 | 2.004 |
| KTINGSGSPHSKAQGVKT | 1717 | 2.002 |
| KTINGSGSPHSKAQFSLT | 1718 | 2.000 |
| KTINMLRSPHSKAQNQQT | 1719 | 2.000 |
| KTINGSGSPHSKAQLGKT | 1720 | 2.000 |
| KTINGSGSPHSMYLNQQT | 1721 | 2.000 |

As shown in Table 14, approximately 72 TTM-002 matured capsid variants demonstrated at least a 2-fold increase in expression relative to the non-matured TTM-002 control, with a few variants demonstrating greater than a three- to five-fold enrichment relative to the non-matured TTM-002 control. Also, across the peptides comprised within the TTM-002 matured capsid variants with the greatest fold-enrichment relative to the non-matured TTM-002 capsid in the brain, it was observed that the modifications in the variant sequences appeared in the region N-terminal to the SPH motif present within the capsid variant. This indicates that modifications that appeared to improve TTM-002 capsid tropism in the CNS of mice were skewed to the N-terminal portion of the peptide insertion in loop IV of the sequence. Additionally, a number of these N-terminal modifications that were incorporated into the matured TTM-002 capsid variants were negatively charged amino acids (particularly glutamic acid (E)).

TABLE 14

NGS fold-enrichment of TTM-002 matured AAV capsid variants in the brain of CD-1 Outbred mice

| Peptide Sequence | SEQ ID NO: | Fold enrichment over TTM-002 | Peptide Sequence | SEQ ID NO: | Fold enrichment over TTM-002 |
|---|---|---|---|---|---|
| KTINGHDSPHVTDQNQQT | 1722 | 5.20 | KAEVGHDSPHKSGQNQQT | 1760 | 2.15 |
| KTINGHDSPHKRGQHRQT | 1723 | 4.20 | KMDAGHDSPHKSGQNQQT | 1761 | 2.15 |
| KMPEGHDSPHKSGQNQQT | 1724 | 3.18 | KVEWGHDSPHKSGQNQQT | 1762 | 2.15 |
| KMEGGHDSPHKSGQNQQT | 1725 | 2.72 | KAEQGHDSPHKSGQNQQT | 1763 | 2.14 |
| KMEYGHDSPHKSGQNQQT | 1726 | 2.71 | KLEWGHDSPHKSGQNQQT | 1764 | 2.14 |
| KAEWGHDSPHKSGQNQQT | 1727 | 2.69 | KTINGHPSPHYLGQNQQT | 1765 | 2.14 |
| KCEWGHDSPHKSGQNQQT | 1728 | 2.68 | KTINGHLSPHYYGQNQQT | 1766 | 2.13 |
| KANNGQDSPHKSGQNQQT | 1729 | 2.67 | KMELGHDSPHKSGQNQQT | 1767 | 2.13 |
| KTINGHDSPHLCGQNQQT | 1730 | 2.59 | KMETGHDSPHKSGQNQQT | 1768 | 2.12 |
| KIPEGHDSPHKSGQNQQT | 1731 | 2.54 | KMEAGHDSPHKSGQNQQT | 1769 | 2.12 |
| KADMGHDSPHKSGQNQQT | 1732 | 2.48 | KTINGHDSPHLLWQNQQT | 1770 | 2.12 |
| KTINGHLSPHYFGQNQQT | 1733 | 2.41 | KTINRQRSPHKSGQNQQT | 1771 | 2.11 |
| KIEYGHDSPHKSGQNQQT | 1734 | 2.41 | KIESGHDSPHKSGQNQQT | 1772 | 2.11 |
| KADYGHDSPHKSGQNQQT | 1735 | 2.40 | KTAKDHDSPHKSGQNQQT | 1773 | 2.11 |
| KIETGHDSPHKSGQNQQT | 1736 | 2.38 | KMEVGHDSPHKSGQNQQT | 1774 | 2.11 |
| KTINGHDSPHTNGQKQQT | 1737 | 2.38 | KCEIGHDSPHKSGQNQQT | 1775 | 2.10 |

TABLE 14-continued NGS fold-enrichment of TTM-002 matured AAV capsid variants in the brain of CD-1 Outbred mice

| Peptide Sequence | SEQ ID NO: | Fold enrichment over TTM-002 | Peptide Sequence | SEQ ID NO: | Fold enrichment over TTM-002 |
|---|---|---|---|---|---|
| KMEWGHDSPHKSGQNQQT | 1738 | 2.38 | KATNGHDSPHKSGLNQQT | 1776 | 2.10 |
| KTINGHDSPHWLLQNQQT | 1739 | 2.37 | KMDGGHDSPHKSGQNQQT | 1777 | 2.09 |
| KCEYGHDSPHKSGQNQQT | 1740 | 2.36 | KQEVGHDSPHKSGQNQQT | 1778 | 2.07 |
| KRINGHDSPHKSGQKQQN | 1741 | 2.34 | KADQGHDSPHKSGQNQQT | 1779 | 2.07 |
| KMEIGHDSPHKSGQNQQT | 1742 | 2.34 | KTINGHESPHKSAQNHQT | 1780 | 2.07 |
| KLEYGHDSPHKSGQNQQT | 1743 | 2.33 | KTINGHDSPHKSAQNQWT | 1781 | 2.07 |
| KADWGHDSPHKSGQNQQT | 1744 | 2.32 | KNMNGHDSPHKSGQNTHS | 1782 | 2.06 |
| KIEIGHDSPHKSGQNQQT | 1745 | 2.30 | KTPWEHDSPHKSGQNQQT | 1783 | 2.05 |
| KTIKDNDSPHKSGQNQQT | 1746 | 2.27 | KTINGHSSPHYFGQNQQT | 1784 | 2.05 |
| KDIMGHDSPHKSGQNQQT | 1747 | 2.23 | KIEMGHDSPHKSGQNQQT | 1785 | 2.05 |
| KFEQGHDSPHKSGQNQQT | 1748 | 2.22 | KTANEHDSPHKSGQNQQT | 1786 | 2.05 |
| KMEFGHDSPHKSGQNQQT | 1749 | 2.21 | KTINGHDSPHKSGRRRQT | 1787 | 2.04 |
| KCDQGHDSPHKSGQNQQT | 1750 | 2.21 | KISNGHDSPHKSAQNQQT | 1788 | 2.03 |
| KLPEGHDSPHKSGQNQQT | 1751 | 2.19 | KTGNGHDSPHKSGQYQQT | 1789 | 2.03 |
| KIENGHDSPHKSGQNQQT | 1752 | 2.19 | KTINGHYSPHLFGQNQQT | 1790 | 2.02 |
| KMESGHDSPHKSGQNQQT | 1753 | 2.18 | KTINGNYSPHKIGQNQQT | 1791 | 2.02 |
| KAEIGHDSPHKSGQNQQT | 1754 | 2.17 | KTINGHDSPHKSRQNDQT | 1792 | 2.01 |
| KVEYGHDSPHKSGQNQQT | 1755 | 2.17 | KQQQGHDSPHKSGQNQQT | 1793 | 2.01 |
| KIINGHDSPHKSGLTQQT | 1756 | 2.17 | KTPQDHDSPHKSGQNQQT | 1794 | 2.00 |
| KTSNGDDSPHKSGRNQQT | 1757 | 2.17 | KHDWGHDSPHKSGQNQQT | 1795 | 2.00 |
| KIEVGHDSPHKSGQNQQT | 1758 | 2.16 | KIEGGHDSPHKSGQNQQT | 1796 | 2.00 |
| KMEMGHDSPHKSGQNQQT | 1759 | 2.16 | | | |

These data demonstrate that following two maturation approaches, matured TTM-001 and TTM-002 capsid variants with loop IV modifications were generated with significantly enhanced CNS tropism in mice compared to the corresponding non-matured TTM-001 and TTM-002 capsid variants, which already exhibited a significant fold enrichment over AAV9 in the mouse brain.

Example 4. Maturation of TTM-001 and TTM-002 Capsid in NHPs

This Example describes maturation of the AAV9 capsid variants, TTM-001 (SEQ ID NO: 981 (amino acid) and 983 (DNA), comprising SEQ ID NO: 941 (encoded by SEQ ID NO: 942)) and TTM-002 (SEQ ID NO: 982 (amino acid) and 984 (DNA), comprising SEQ ID NO: 2 (encoded by SEQ ID NO: 3)) in NHPs to further enhance their transduction and biodistribution in the central nervous system as well as other tissues, and evolve the AAV capsid variants to provide further cross-species compatibility. Two approaches were used to mature the TTM-001 and TTM-002 capsid sequences in order to randomize and mutate within and around the peptide insert comprised within loop IV of the capsid variant. As many of the AAV capsid variants that demonstrated the greatest fold-enrichment in the NHP brain relative wild-type AAV9 comprised an SPH motif in the same position (e.g., immediately subsequent to position 455, relative to a reference sequence numbered according to the amino acid sequence of SEQ ID NO: 138) (see Example 1), the SPH motif was not mutated in either approach to mature the TTM-001 and TTM-002 capsid variants. In the first maturation approach, sets of three contiguous amino acids were randomized across the mutagenesis region in the TTM-001 and TTM-002 sequences, which spanned from position 450 to position 466, numbered according to SEQ ID NO: 981 and 982. In the second maturation approach, mutagenic primers were used to introduce point mutations at a low frequency, scattered across the mutagenesis region in the TTM-001 and TTM-002 sequences ranging from position 449 to position 466, numbered according to SEQ ID NO: 981 and 982. AAV capsid variants arising from each maturation approach for TTM-001 and TTM-002 were pooled together, for subsequent testing and characterization in NHPs.

The library of pooled matured AAV capsid variants generated using the first maturation approach and the second maturation approach for the TTM-001 and TTM-002 AAV capsid variants were injected into two NHPs. After a period in life, the brains, heart, liver, muscle, and DRG of the NHPs were isolated and RNA was extracted. Following RNA recovery and RT-PCR amplification, a systematic NGS enrichment analysis was performed to calculate the fold enrichment ratio relative to an AAV9 control, and the peptides comprised within the variants were identified.

Following the RNA recovery and NGS analysis from the second maturation approach, approximately 680,000 capsid variants were identified. The 680,000 matured capsid variants were then filtered based on samples with a raw virus count greater than 10 and a coefficient of variance (CV) of less than 1, which was calculated for each peptide across the brain samples taken from the two NHPs. Those that had a CV value <1 were identified, as these were the peptides that were reliably detected in the majority of samples isolated from the brains of the two NHPs. Using this filtering criteria, this led to approximately 64,000 matured capsid variants.

Table 15 provides the peptide sequences of the matured capsid variants having a raw virus count greater than 10, a CV of less than 1 for the brain samples isolated, and that also demonstrated a 50-fold or greater fold-increase in expression in the brain relative to the AAV9 control in both mice and NHPs. The matured variants in Table 15, were also those variants that had a fold-change in expression that was less than 2 relative to the AAV9 control in the liver and the DRG. Applying these criteria, approximately 350 matured capsid variants were identified that demonstrated high transduction in the brain in NHPs and mice, cross-species compatibility in mice and NHPs, and were de-targeted in the liver and DRG, relative to the AAV9 control. Several variants as shown in Table 15, led to greater than 100-fold increase in expression relative to AAV9 in the NHP and/or mouse brain, with one variant resulting in a greater than 200-fold increase in expression relative to AAV9 in both species.

Fold-change in expression for the TTM-001 and TTM-002 matured variants in Table 15 that showed increased expression in the brain of the NHPs and mice, were also calculated for the DRG, muscle, liver (RNA and DNA), and heart of the NHPs following each maturation approach. As shown in Table 15, many variants were de-targeted in the peripheral tissues with a lower fold-change in expression relative to the AAV9 control, demonstrating CNS-specific tropism and a preferential transduction of the brain and CNS. Some variants demonstrated increased expression to AAV9 in multiple tissues, including the brain and peripheral tissues, demonstrating pan-tropism.

TABLE 15

NGS fold-enrichment of TTM-001 and TTM-002 matured AAV capsid variants in th ebrain of NHPs and mice

| Sequence | SEQ ID NO: | Brain (NHP) | DRG (NHP) | Heart (NHP) | Muscle (NHP) | Liver RNA (NHP) | Liver DNA (NHP) | Brain (Mouse) |
|---|---|---|---|---|---|---|---|---|
| KTIIGSGSPHSKAQNRHT | 3239 | 217.176 | 0.000 | 0.000 | 0.000 | 0.000 | 0.000 | 210.515 |
| KTFPGSGSPHSKVQNQQT | 3240 | 199.720 | 0.000 | 0.000 | 0.000 | 0.000 | 0.967 | 97.703 |
| KTEKMSGSPHSKAQNQQT | 3241 | 169.461 | 0.523 | 0.000 | 0.000 | 0.000 | 0.158 | 109.161 |
| KEINGRGSPHSKAQNQQT | 3527 | 134.390 | 0.239 | 0.000 | 0.000 | 0.000 | 0.232 | 52.311 |
| KTVNRNGSPHSKAQNQQT | 3528 | 133.016 | 0.000 | 0.416 | 0.000 | 0.000 | 0.000 | 85.361 |
| KTVNGSGSPHSKARDQQT | 3242 | 124.789 | 0.123 | 0.039 | 0.312 | 0.569 | 0.454 | 132.137 |
| KTFNGSGSPHSKAPNLQT | 3243 | 121.436 | 0.000 | 0.167 | 0.000 | 0.000 | 0.015 | 168.920 |
| KTEKTSGSPHSKAQNQQT | 3244 | 120.337 | 0.000 | 0.355 | 0.000 | 0.000 | 0.119 | 101.467 |
| KTINGSGSPHSKAHVRQT | 3245 | 119.798 | 0.000 | 0.000 | 0.262 | 0.694 | 1.039 | 165.590 |
| KTVNGSGSPHSKAPNQHT | 3246 | 117.207 | 0.000 | 0.109 | 0.000 | 0.000 | 0.074 | 51.008 |
| KTEKISGSPHSKAQNQQT | 3247 | 116.603 | 0.000 | 0.000 | 0.000 | 0.000 | 0.426 | 102.978 |
| KTINGPGSPHSKAHNQQT | 3529 | 115.742 | 0.146 | 0.000 | 0.235 | 0.000 | 0.513 | 52.508 |
| KTVNGSGSPHSKTQSQQT | 3248 | 115.086 | 0.000 | 0.726 | 0.000 | 0.000 | 0.340 | 63.248 |
| TTINGSGSPHSKAQNQQT | 3249 | 114.856 | 1.340 | 14.856 | 0.827 | 1.281 | 0.957 | 72.058 |
| KSINESGSPHSKAQNQQI | 3250 | 113.833 | 0.000 | 0.000 | 0.000 | 0.000 | 0.000 | 67.649 |
| KTERTSGSPHSKAQNQQT | 3251 | 112.957 | 0.000 | 0.009 | 0.000 | 1.128 | 0.207 | 117.374 |
| KTINGSGSPHSKAQPAKT | 3252 | 111.472 | 0.331 | 0.000 | 1.089 | 0.044 | 1.796 | 215.275 |
| KTEKSSGSPHSKAQNQQT | 3253 | 107.470 | 0.000 | 0.016 | 0.014 | 0.977 | 0.179 | 100.177 |
| KTSYGNGSPHSKAQNQQT | 3530 | 105.937 | 0.000 | 0.000 | 0.000 | 0.000 | 0.114 | 105.894 |

TABLE 15-continued

NGS fold-enrichment of TTM-001 and TTM-002 matured AAV capsid variants in th ebrain of NHPs and mice

| | | Fold Enrichment relative to AAV9 | | | | | | |
|---|---|---|---|---|---|---|---|---|
| Sequence | SEQ ID NO: | Brain (NHP) | DRG (NHP) | Heart (NHP) | Muscle (NHP) | Liver RNA (NHP) | Liver DNA (NHP) | Brain (Mouse) |
| KTEKGSGSPHSKAQNQQT | 3254 | 105.614 | 0.053 | 0.031 | 0.000 | 0.586 | 0.169 | 84.653 |
| KTINGSGSPHSKSQTQQN | 3255 | 104.474 | 0.000 | 0.131 | 0.000 | 0.084 | 0.038 | 54.021 |
| KTERISGSPHSKAQNQQT | 3256 | 103.692 | 0.000 | 0.000 | 0.000 | 0.062 | 0.370 | 89.637 |
| KTERASGSPHSKAQNQQT | 3257 | 103.669 | 0.000 | 0.000 | 0.000 | 0.127 | 0.070 | 115.550 |
| KELHGSGSPHSKAQNQQT | 3258 | 102.680 | 0.000 | 0.000 | 0.000 | 1.634 | 0.592 | 96.554 |
| KAINGSGSPHSKAQNLAT | 3259 | 101.954 | 0.000 | 10.954 | 8.655 | 0.298 | 0.239 | 116.685 |
| KTVNGSGSPHSKSQNQLT | 3260 | 101.327 | 0.000 | 0.035 | 0.000 | 0.000 | 0.025 | 80.716 |
| KTERNSGSPHSKAQNQQT | 3261 | 99.892 | 0.000 | 0.000 | 0.000 | 0.000 | 0.107 | 87.392 |
| KSVNGNGSPHSKAQNQQT | 3531 | 99.385 | 0.000 | 1.329 | 0.000 | 0.359 | 0.079 | 51.016 |
| KTFNGSGSPHSKAQGQQT | 3262 | 99.253 | 0.000 | 0.208 | 0.000 | 0.128 | 0.099 | 81.459 |
| KTINGSGSPHGWVQNQQT | 3532 | 97.122 | 0.000 | 0.000 | 0.000 | 1.240 | 1.975 | 290.720 |
| KTERVSGSPHSKAQNQQT | 3263 | 96.943 | 0.000 | 0.000 | 0.000 | 0.000 | 0.144 | 135.438 |
| KTINGSGSPHSKALNRQS | 3264 | 96.843 | 0.136 | 0.532 | 0.000 | 0.042 | 0.178 | 55.945 |
| KTERLSGSPHSKAQNQQT | 3265 | 95.857 | 0.000 | 0.004 | 0.005 | 0.126 | 0.260 | 102.372 |
| KTDNGSGSPHSKAHNQQT | 3266 | 95.164 | 0.000 | 0.000 | 0.000 | 0.000 | 0.027 | 55.313 |
| KTFHGSGSPHSKTQNQQT | 3267 | 94.714 | 0.000 | 0.210 | 0.120 | 0.000 | 0.000 | 51.119 |
| KTINGGGSPHSKAQTQQI | 3533 | 92.345 | 0.000 | 0.000 | 0.000 | 0.000 | 0.023 | 54.199 |
| KTSNGSGSPHSKAQNPPT | 3268 | 91.528 | 0.000 | 0.000 | 0.000 | 0.000 | 0.039 | 51.541 |
| ETINGSGSPHSKAQNLQT | 3269 | 90.969 | 0.221 | 1.023 | 0.197 | 0.179 | 0.813 | 107.216 |
| KTVHGNGSPHSKAQNQQT | 3534 | 90.073 | 0.000 | 0.000 | 0.000 | 0.000 | 0.304 | 97.003 |
| NTINGSGSPHSKAQNQQT | 3270 | 90.017 | 1.712 | 1.261 | 1.171 | 0.923 | 0.540 | 55.179 |
| KTINGGGSPHSKAQNQQC | 3535 | 89.301 | 0.219 | 0.000 | 0.000 | 0.287 | 0.319 | 53.840 |
| KTENMSGSPHSKAQNQQT | 3271 | 89.247 | 0.000 | 0.000 | 0.000 | 0.000 | 0.260 | 130.568 |
| KTENVSGSPHSKAQNQQT | 3272 | 88.506 | 0.000 | 0.000 | 0.000 | 0.964 | 0.112 | 108.591 |
| KTSSGSGSPHSKAQYQQT | 3273 | 87.304 | 0.000 | 0.000 | 0.000 | 0.000 | 0.299 | 58.143 |
| KTIDGGGSPHSKAQNKQT | 3536 | 85.019 | 0.000 | 0.000 | 0.000 | 0.000 | 0.477 | 55.517 |
| KTEKVSGSPHSKAQNQQT | 3274 | 84.558 | 0.000 | 0.022 | 0.000 | 0.873 | 0.424 | 112.185 |
| KAINGSGSPHSKAQDQET | 3275 | 84.080 | 0.000 | 0.000 | 0.000 | 0.194 | 0.027 | 87.637 |
| KTCNKSGSPHSKAQNQQT | 3276 | 83.992 | 0.000 | 0.000 | 0.165 | 0.283 | 0.000 | 119.496 |
| KTINGGGSPHSKAQNQLI | 3537 | 83.881 | 0.000 | 0.000 | 0.000 | 0.046 | 0.387 | 78.383 |
| KNINGGGSPHSKAQNQQT | 3538 | 83.083 | 0.000 | 0.042 | 0.000 | 0.000 | 0.000 | 75.913 |
| KTEHLSGSPHSKAQNQQT | 3277 | 83.080 | 0.000 | 0.000 | 0.012 | 0.021 | 0.189 | 69.494 |
| KAEMGSGSPHSKAQNQQT | 3278 | 83.049 | 0.000 | 0.020 | 0.000 | 0.768 | 0.112 | 135.019 |
| KATNGSGSPHSKAQNHQT | 3279 | 82.627 | 0.000 | 0.176 | 0.000 | 0.155 | 0.057 | 66.207 |
| KAIKGSGSPHSKAQDQQT | 3280 | 82.258 | 0.000 | 0.000 | 0.000 | 0.108 | 0.000 | 85.178 |

TABLE 15-continued

NGS fold-enrichment of TTM-001 and TTM-002 matured AAV capsid variants in th ebrain of NHPs and mice

| | | Fold Enrichment relative to AAV9 | | | | | | |
|---|---|---|---|---|---|---|---|---|
| Sequence | SEQ ID NO: | Brain (NHP) | DRG (NHP) | Heart (NHP) | Muscle (NHP) | Liver RNA (NHP) | Liver DNA (NHP) | Brain (Mouse) |
| KTINGGGSPHSKSQNQLT | 3539 | 82.231 | 0.000 | 0.070 | 0.000 | 0.000 | 0.498 | 126.986 |
| KTVNGNGSPHSKAQNKQT | 3540 | 81.481 | 0.000 | 0.000 | 0.000 | 0.000 | 0.122 | 69.455 |
| KTINGSGSPHSKGHWQQT | 3281 | 81.434 | 0.000 | 0.000 | 0.000 | 0.000 | 1.011 | 65.252 |
| KTDKTSGSPHSKAQNQQT | 3282 | 81.430 | 0.000 | 0.000 | 0.000 | 1.362 | 0.291 | 169.515 |
| KTFKGSGSPHSKAPNQQT | 3283 | 80.890 | 0.000 | 0.000 | 0.000 | 0.000 | 0.017 | 71.144 |
| KTVNGSGSPHSKAQNQLI | 3284 | 80.509 | 0.000 | 0.000 | 0.000 | 0.000 | 0.166 | 71.156 |
| KTINGSGSPHSKRPEQQT | 3285 | 80.418 | 0.000 | 0.013 | 0.000 | 0.149 | 0.361 | 50.319 |
| KTINGSGSPHSKAQRTMT | 3286 | 80.388 | 0.000 | 0.022 | 0.170 | 1.812 | 1.025 | 100.248 |
| KTEKASGSPHSKAQNQQT | 3287 | 80.285 | 0.000 | 0.041 | 0.000 | 0.000 | 0.261 | 90.390 |
| KSDQGSGSPHSKAQNQQT | 3288 | 80.076 | 0.000 | 0.000 | 0.000 | 0.993 | 0.124 | 151.911 |
| KTEITSGSPHSKAQNQQT | 3289 | 79.620 | 0.000 | 0.163 | 0.000 | 0.332 | 0.074 | 76.686 |
| KTDKSSGSPHSKAQNQQT | 3290 | 79.470 | 0.055 | 0.012 | 0.000 | 1.437 | 0.367 | 141.351 |
| KTIDGSGSPHSKAQNQQH | 3291 | 79.090 | 0.000 | 0.000 | 0.000 | 0.136 | 0.049 | 57.914 |
| KTVNGNGSPHSKAQNQHT | 3541 | 78.849 | 0.000 | 0.000 | 0.000 | 0.000 | 0.045 | 54.086 |
| KNINGSGSPHSKAQNQQT | 3292 | 78.445 | 0.000 | 0.000 | 0.000 | 0.571 | 0.177 | 89.719 |
| KTETHSGSPHSKAQNQQT | 3293 | 77.974 | 0.000 | 0.067 | 0.000 | 0.000 | 0.512 | 57.287 |
| KTINGGGSPHSKALNQQN | 3542 | 77.822 | 0.000 | 0.131 | 0.000 | 0.000 | 0.274 | 69.884 |
| KTINGSGSPHSKALHQHT | 3294 | 77.502 | 0.000 | 0.052 | 0.041 | 0.000 | 0.188 | 68.196 |
| KTINGTGSPHSKAQNHQI | 3543 | 77.089 | 0.171 | 0.000 | 0.000 | 0.000 | 0.166 | 54.281 |
| KTINGSGSPHSKAQHRIT | 3295 | 76.849 | 0.105 | 0.499 | 0.170 | 1.424 | 0.214 | 127.000 |
| KTINGSGSPHSKAQYIHT | 3296 | 76.170 | 0.000 | 0.014 | 0.033 | 1.523 | 0.168 | 59.649 |
| KTENISGSPHSKAQNQQT | 3297 | 76.072 | 0.000 | 0.000 | 0.000 | 0.115 | 0.132 | 83.118 |
| KTIIGGGSPHSKAHNQQT | 3544 | 75.872 | 0.000 | 0.050 | 0.000 | 0.000 | 0.235 | 65.492 |
| KTINGSGSPHSKAQKFET | 3298 | 75.788 | 0.000 | 0.000 | 0.028 | 0.108 | 0.093 | 65.588 |
| KTSNESGSPHSKAQNHQT | 3299 | 75.720 | 0.000 | 0.000 | 0.000 | 0.169 | 0.217 | 70.590 |
| KTINGSGSPHSKAQFPST | 3300 | 75.677 | 0.000 | 0.004 | 0.000 | 0.849 | 0.127 | 119.712 |
| KTERPSGSPHSKAQNQQT | 3301 | 75.669 | 0.000 | 0.029 | 0.000 | 0.000 | 0.156 | 73.894 |
| KTINGNGSPHSKAQNPLT | 3545 | 75.269 | 0.000 | 0.000 | 0.000 | 0.366 | 0.000 | 53.583 |
| KSIKGNGSPHSKAQNQQT | 3546 | 75.196 | 0.000 | 0.000 | 0.000 | 0.000 | 0.000 | 90.251 |
| KTERMSGSPHSKAQNQQT | 3302 | 74.910 | 0.000 | 0.000 | 0.000 | 0.100 | 0.151 | 122.812 |
| KTERSSGSPHSKAQNQQT | 3303 | 74.853 | 0.000 | 0.071 | 0.000 | 1.036 | 0.056 | 125.538 |
| KTELHSGSPHSKAQNQQT | 3304 | 74.620 | 0.000 | 0.000 | 0.000 | 0.021 | 0.089 | 53.124 |
| KTELTSGSPHSKAQNQQT | 3305 | 74.548 | 0.000 | 0.000 | 0.000 | 0.537 | 0.421 | 100.311 |
| KTINGSGSPHSKAHNQQR | 3306 | 74.272 | 0.562 | 0.486 | 0.047 | 0.956 | 0.057 | 107.301 |
| KTINGGGSPHSKAQSQQI | 3547 | 74.264 | 0.000 | 0.000 | 0.000 | 0.000 | 0.235 | 67.651 |
| KTINGSGSPHSKAQAIKT | 3307 | 74.261 | 0.255 | 0.000 | 0.000 | 0.186 | 0.132 | 73.560 |

TABLE 15-continued

NGS fold-enrichment of TTM-001 and TTM-002 matured AAV capsid variants in the brain of NHPs and mice

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KTENTSGSPHSKAQNQQT | 3308 | 74.061 | 0.000 | 0.000 | 0.218 | 0.233 | 0.730 | 96.249 |
| KTIDGSGSPHSKGQNRQT | 3309 | 73.930 | 0.000 | 0.000 | 0.000 | 0.106 | 0.091 | 63.626 |
| KNINGSGSPHSKAQSQQT | 3310 | 73.757 | 0.000 | 0.000 | 0.000 | 0.000 | 0.041 | 57.432 |
| KTINGSVSPHGKAQNQLT | 3548 | 73.525 | 0.000 | 0.061 | 0.067 | 0.000 | 0.053 | 51.358 |
| KTSNASGSPHSKAQNQLT | 3311 | 73.501 | 0.000 | 0.000 | 0.297 | 0.000 | 0.313 | 150.401 |
| KTEARSGSPHSKAQNQQT | 3312 | 73.349 | 0.000 | 0.000 | 0.000 | 0.695 | 0.118 | 62.903 |
| KTEKNSGSPHSKAQNQQT | 3313 | 73.347 | 0.000 | 0.000 | 0.044 | 0.159 | 0.021 | 74.393 |
| KTANGSGSPHSKAQYQQT | 3314 | 73.038 | 0.000 | 0.000 | 0.000 | 0.153 | 0.160 | 139.451 |
| KTVNGSGSPHSKAQYQHT | 3315 | 72.847 | 0.000 | 0.000 | 0.000 | 0.000 | 0.130 | 54.158 |
| KTINGSGSPHTKAQNPQS | 3316 | 72.594 | 0.000 | 0.000 | 0.000 | 0.000 | 0.130 | 62.508 |
| KTINGSGSPHSKGQNPPT | 3317 | 72.339 | 0.000 | 0.206 | 0.000 | 0.000 | 0.041 | 134.808 |
| KTIIGSGSPHSKAQHQLT | 3318 | 72.291 | 0.000 | 0.000 | 0.000 | 0.000 | 0.000 | 100.144 |
| KTINGSGSPHSKAQSPPT | 3319 | 71.632 | 0.069 | 0.047 | 0.274 | 0.179 | 0.425 | 97.111 |
| NTIYGSGSPHSKAQNQQT | 3320 | 71.267 | 1.739 | 0.000 | 273.69 | 0.000 | 0.209 | 59.707 |
| KTINGSGSPHSKAQAKLT | 3321 | 71.154 | 0.000 | 0.273 | 0.017 | 1.591 | 0.777 | 130.132 |
| KTDKNSGSPHSKAQNQQT | 3322 | 70.964 | 0.000 | 0.000 | 0.000 | 0.070 | 0.123 | 62.932 |
| KTINGSGSPHSKTKSQQT | 3323 | 70.891 | 0.000 | 0.568 | 0.045 | 0.418 | 0.496 | 83.923 |
| KTINGSGSPHSKAQDRPT | 3324 | 70.831 | 0.132 | 0.006 | 0.000 | 0.039 | 0.379 | 66.800 |
| KTINGIGSPHSKAQNLGT | 3549 | 70.543 | 0.000 | 0.071 | 0.000 | 0.000 | 0.135 | 104.769 |
| KTINGSGSPHSKAQSQQL | 3325 | 70.539 | 0.000 | 0.000 | 0.000 | 0.000 | 0.041 | 51.126 |
| KTENLSGSPHSKAQNQQT | 3326 | 70.303 | 0.070 | 0.000 | 0.000 | 0.395 | 0.470 | 107.385 |
| KTINGSGSPHSKAQAFHT | 3327 | 70.159 | 0.033 | 0.000 | 0.058 | 0.762 | 0.119 | 86.268 |
| KTINGSGSPHSKAQKQQD | 3328 | 70.116 | 0.000 | 0.024 | 0.000 | 0.064 | 0.083 | 110.196 |
| KTFSGSGSPHSKAQNLQT | 3329 | 70.035 | 0.000 | 0.327 | 0.303 | 0.000 | 0.228 | 70.917 |
| KAINGSGSPHSKAQNAQT | 3330 | 69.651 | 0.000 | 0.000 | 0.000 | 0.023 | 0.142 | 72.160 |
| KTESWSGSPHSKAQNQQT | 3331 | 69.144 | 0.000 | 0.000 | 0.000 | 0.000 | 0.019 | 67.699 |
| KTTNGSGSPHSKAHNQLT | 3332 | 69.062 | 0.000 | 0.000 | 0.000 | 0.708 | 0.000 | 65.505 |
| KTVNGNGSPHSKAQNHQT | 3550 | 68.889 | 0.000 | 0.000 | 0.000 | 0.000 | 0.030 | 52.482 |
| KTEDKSGSPHSKAQNQQT | 3333 | 68.813 | 0.000 | 0.000 | 0.000 | 0.000 | 0.000 | 70.071 |
| KTESASGSPHSKAQNQQT | 3334 | 68.651 | 0.000 | 0.000 | 0.000 | 0.274 | 0.084 | 80.500 |
| KTNNGSGSPHSKAQNQQY | 3335 | 68.530 | 0.000 | 0.040 | 0.000 | 0.000 | 0.059 | 82.656 |
| KTSNGGSGSPHSKAQNLQT | 3551 | 68.311 | 0.000 | 0.052 | 0.000 | 0.000 | 0.000 | 124.871 |
| KTDKMSGSPHSKAQNQQT | 3336 | 68.167 | 0.000 | 0.000 | 0.000 | 0.017 | 0.205 | 88.234 |
| KEVHGSGSPHSKAQNQQT | 3337 | 67.901 | 0.000 | 0.000 | 0.000 | 0.727 | 0.000 | 100.111 |
| KTINGSGSPHSKAQKLNT | 3338 | 67.782 | 0.073 | 0.092 | 0.000 | 1.232 | 0.201 | 68.637 |

TABLE 15-continued

NGS fold-enrichment of TTM-001 and TTM-002 matured AAV capsid variants in the brain of NHPs and mice

| | | Fold Enrichment relative to AAV9 | | | | | | |
|---|---|---|---|---|---|---|---|---|
| Sequence | SEQ ID NO: | Brain (NHP) | DRG (NHP) | Heart (NHP) | Muscle (NHP) | Liver RNA (NHP) | Liver DNA (NHP) | Brain (Mouse) |
| KTINGGGSPHSKSQNQHT | 3552 | 67.773 | 0.000 | 0.057 | 0.000 | 0.000 | 0.220 | 100.748 |
| KTVNGGGSPHSKAQSQQT | 3553 | 67.634 | 0.000 | 0.055 | 0.000 | 0.000 | 0.210 | 160.711 |
| KTTNGSGSPHSKAQYQHT | 3339 | 67.325 | 0.000 | 0.000 | 0.000 | 1.378 | 0.080 | 83.337 |
| KTISGSGSPHSKAQYQHT | 3340 | 66.739 | 0.000 | 0.000 | 0.000 | 0.000 | 0.191 | 59.822 |
| KTESTSGSPHSKAQNQQT | 3341 | 66.649 | 0.000 | 0.009 | 0.000 | 1.688 | 0.176 | 95.861 |
| KTINGSGSPHSKSQNVQT | 3342 | 66.627 | 0.000 | 0.190 | 0.000 | 0.202 | 0.188 | 56.672 |
| KSINGSGSPHSKAQAQQT | 3343 | 66.464 | 0.000 | 0.711 | 0.000 | 0.148 | 0.111 | 78.451 |
| KTVNGSGSPHSKAQNLQA | 3344 | 66.379 | 0.000 | 0.000 | 0.000 | 0.000 | 0.132 | 50.934 |
| KTVRDSGSPHSKAQNQQT | 3345 | 66.056 | 0.000 | 0.025 | 0.000 | 0.129 | 0.461 | 142.600 |
| KTFNASGSPHSKAPNQQT | 3346 | 65.392 | 0.208 | 0.000 | 0.000 | 0.215 | 0.156 | 66.275 |
| KTDRMSGSPHSKAQNQQT | 3347 | 65.143 | 0.000 | 0.000 | 0.000 | 0.332 | 0.103 | 104.890 |
| KTINGSGSPHSKAQTPPT | 3348 | 64.657 | 0.010 | 0.015 | 0.014 | 0.200 | 0.207 | 54.179 |
| ETIKGSGSPHSKAQNQQT | 3349 | 64.609 | 0.000 | 0.000 | 0.144 | 0.000 | 0.024 | 67.201 |
| KNHIGSGSPHSKAQNQQT | 3350 | 64.535 | 0.000 | 0.000 | 0.000 | 1.253 | 0.187 | 70.356 |
| KTINGSGSPHSKAQYQHA | 3351 | 64.435 | 0.000 | 0.000 | 0.024 | 0.993 | 0.097 | 57.278 |
| KTIPIDGSPHSKAQNQQT | 3554 | 64.421 | 0.000 | 0.047 | 0.000 | 0.234 | 0.936 | 76.826 |
| KTINGSGSPHSKAQGQQA | 3352 | 64.128 | 0.000 | 0.185 | 0.000 | 0.063 | 0.195 | 64.116 |
| KTFNGSGSPHNKAQNHQT | 3353 | 64.060 | 0.000 | 0.000 | 0.035 | 0.094 | 0.317 | 67.757 |
| KESDGSGSPHSKAQNQQT | 3354 | 63.766 | 0.000 | 0.000 | 0.000 | 0.567 | 0.146 | 115.231 |
| KTINGSGSPHSKAQPPAT | 3355 | 63.510 | 0.048 | 0.030 | 0.031 | 0.126 | 0.302 | 117.453 |
| KTINGSGSPHSKAQERPT | 3356 | 63.460 | 0.000 | 0.011 | 0.000 | 0.810 | 0.173 | 57.506 |
| KTIKGSGSPHSKAQDLQT | 3357 | 63.260 | 0.000 | 0.000 | 0.000 | 0.000 | 0.218 | 58.576 |
| KTDLKSGSPHSKAQNQQT | 3358 | 63.152 | 0.000 | 0.000 | 0.012 | 0.285 | 0.377 | 62.687 |
| KTINGGGSPHSKAQNPPT | 3555 | 63.041 | 0.000 | 0.082 | 0.000 | 0.000 | 0.057 | 64.045 |
| KTINGSGSPHSKAQAMHT | 3359 | 62.756 | 0.000 | 0.000 | 0.010 | 0.976 | 0.393 | 84.056 |
| KTVPNSGSPHSKAQNQQT | 3360 | 62.540 | 0.000 | 0.000 | 0.011 | 0.202 | 0.161 | 93.793 |
| KTVIGSGSPHSKALNQQT | 3361 | 62.358 | 0.000 | 0.310 | 0.000 | 0.062 | 0.245 | 60.369 |
| KTINGSGSPHSKAQHPST | 3362 | 62.255 | 0.000 | 0.044 | 0.000 | 1.345 | 0.301 | 101.103 |
| KTINGLGSPHSKSQNQQT | 3556 | 62.170 | 0.000 | 0.157 | 0.000 | 0.146 | 0.107 | 64.139 |
| KTINGTGSPHSKAQNQQM | 3557 | 62.151 | 0.000 | 0.000 | 0.000 | 0.000 | 0.000 | 62.376 |
| KTINGSGSPHSKAPGLQT | 3363 | 62.043 | 0.007 | 0.000 | 0.005 | 0.651 | 0.210 | 144.610 |
| KTINGSGSPHSKAQGIRT | 3364 | 61.952 | 0.041 | 0.000 | 0.012 | 0.897 | 0.502 | 155.013 |
| KTESHSGSPHSKAQNQQT | 3365 | 61.947 | 0.000 | 0.000 | 0.000 | 1.480 | 0.106 | 52.506 |
| KTINGSGSPHSKAQAPAT | 3366 | 61.934 | 0.000 | 0.169 | 0.015 | 0.696 | 0.197 | 127.420 |
| KTINGSGSPHSKSQSQQI | 3367 | 61.870 | 0.000 | 0.000 | 0.000 | 0.200 | 0.175 | 64.027 |
| KAEHGSGSPHSKAQNQQT | 3368 | 61.830 | 0.000 | 0.000 | 0.000 | 0.772 | 0.184 | 116.201 |

TABLE 15-continued

NGS fold-enrichment of TTM-001 and TTM-002 matured AAV capsid variants in th ebrain of NHPs and mice

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KTEDRSGSPHSKAQNQQT | 3369 | 61.756 | 0.000 | 0.000 | 0.000 | 1.004 | 0.408 | 66.887 |
| KNCLGSGSPHSKAQNQQT | 3370 | 61.442 | 0.000 | 0.036 | 0.000 | 1.849 | 0.026 | 82.488 |
| KTDRGSGSPHSKAQNQQT | 3371 | 61.419 | 0.000 | 0.004 | 0.000 | 0.211 | 0.316 | 74.256 |
| KTINGSGSPHSKAQIPPT | 3372 | 61.258 | 0.000 | 0.000 | 0.000 | 0.758 | 0.115 | 87.661 |
| KTVKGSGSPHSKAQDQQT | 3373 | 61.175 | 0.000 | 0.041 | 0.000 | 0.432 | 0.090 | 58.114 |
| KNADGSGSPHSKAQNQQT | 3374 | 60.944 | 0.000 | 0.000 | 0.000 | 1.239 | 0.085 | 104.503 |
| KTDKVSGSPHSKAQNQQT | 3375 | 60.935 | 0.000 | 0.015 | 0.000 | 0.765 | 0.128 | 146.657 |
| KTITGSGSPHSKAQTQLT | 3376 | 60.846 | 0.160 | 8.992 | 0.000 | 0.000 | 0.000 | 55.640 |
| KTINGSGSPHSKAQAPST | 3377 | 60.696 | 0.200 | 0.005 | 0.000 | 0.751 | 0.263 | 115.528 |
| KNCVGSGSPHSKAQNQQT | 3378 | 60.535 | 0.000 | 0.000 | 0.000 | 0.018 | 0.282 | 96.175 |
| KTIRDAGSPHSKAQNQQT | 3558 | 60.346 | 0.000 | 0.000 | 0.000 | 0.141 | 0.251 | 113.179 |
| KTVKDSGSPHSKAQNQQT | 3379 | 60.216 | 0.000 | 0.019 | 0.000 | 0.443 | 0.251 | 87.334 |
| KNALGSGSPHSKAQNQQT | 3380 | 60.014 | 0.000 | 0.003 | 0.000 | 0.682 | 0.213 | 137.222 |
| KVINGSGSPHSKGQNQQT | 3381 | 60.001 | 0.000 | 0.000 | 0.031 | 0.264 | 0.157 | 68.532 |
| KTVNGGGSPHSKAQNQQS | 3559 | 59.871 | 0.062 | 0.020 | 0.000 | 0.080 | 0.185 | 61.847 |
| KTIQDGGSPHSKAQNQQT | 3560 | 59.865 | 0.000 | 0.000 | 0.116 | 1.435 | 0.789 | 87.522 |
| KTISGGGSPHSKAQNQQN | 3561 | 59.801 | 0.000 | 0.000 | 0.000 | 0.722 | 0.039 | 87.761 |
| KTSNASGSPHSKAHNQQT | 3382 | 59.607 | 0.000 | 0.078 | 0.067 | 0.031 | 0.050 | 67.967 |
| KTINGSGSPHSKAQNTYA | 3383 | 59.603 | 0.000 | 0.000 | 0.000 | 0.425 | 0.346 | 101.715 |
| KTINGSGSPHSKSQNQHI | 3384 | 59.438 | 0.000 | 0.099 | 0.000 | 0.111 | 0.108 | 76.025 |
| KTINGGGSPHSKAQDKQT | 3562 | 59.322 | 0.000 | 0.000 | 0.000 | 0.000 | 0.093 | 50.764 |
| KTEFVSGSPHSKAQNQQT | 3385 | 59.306 | 0.000 | 0.000 | 0.000 | 0.196 | 0.276 | 69.788 |
| KTVNGSGSPHSKAQNHLT | 3386 | 59.239 | 0.133 | 0.034 | 0.000 | 0.000 | 0.156 | 70.786 |
| KTREISGSPHSKAQNQQT | 3387 | 59.027 | 0.000 | 0.042 | 0.224 | 0.356 | 0.269 | 51.696 |
| KTINGSGSPHSKAQIGMT | 3388 | 59.013 | 0.081 | 106.528 | 0.000 | 1.003 | 0.248 | 134.585 |
| KTIDGSGSPHSKALNKQT | 3389 | 58.992 | 0.000 | 0.267 | 0.000 | 0.000 | 0.056 | 74.626 |
| KTIIGGGSPHSKAQNPQT | 3563 | 58.924 | 0.000 | 0.202 | 0.000 | 0.000 | 0.126 | 53.992 |
| KQGEGSGSPHSKAQNQQT | 3390 | 58.752 | 0.000 | 0.000 | 0.000 | 0.000 | 0.151 | 135.300 |
| KTINGTGSPHSKAPNQLT | 3564 | 58.738 | 0.000 | 0.000 | 0.000 | 0.229 | 0.035 | 86.939 |
| KTVNGSGSPHSKAQLQQT | 3391 | 58.681 | 0.315 | 0.465 | 0.045 | 0.529 | 0.333 | 81.201 |
| KTFNGGGSPHSKAQYQQT | 3565 | 58.609 | 0.000 | 0.000 | 0.000 | 0.163 | 0.045 | 72.618 |
| KSINGSGSPHSKTQSQQT | 3392 | 58.608 | 0.000 | 3.017 | 0.000 | 0.155 | 0.017 | 71.397 |
| KTVNGGGSPHSKAQHQQT | 3566 | 58.602 | 0.729 | 0.000 | 0.000 | 0.000 | 0.043 | 138.544 |
| KSEKGSGSPHSKAQNQQT | 3393 | 58.566 | 0.000 | 0.010 | 0.011 | 1.601 | 0.059 | 158.931 |
| KNVNGSGSPHSKAQNQQT | 3394 | 58.481 | 0.000 | 0.000 | 0.000 | 0.917 | 0.166 | 53.379 |

TABLE 15-continued

NGS fold-enrichment of TTM-001 and TTM-002 matured AAV capsid variants in the brain of NHPs and mice

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KGGEGSGSPHSKAQNQQT | 3395 | 58.472 | 0.000 | 0.034 | 0.000 | 0.037 | 0.066 | 91.023 |
| KTINGSGSPHSKAQRMST | 3396 | 58.435 | 0.192 | 0.037 | 0.000 | 1.707 | 0.882 | 53.414 |
| KTINGSGSPHSKAQGILT | 3397 | 58.418 | 0.000 | 0.005 | 0.010 | 0.569 | 0.192 | 102.631 |
| KEFVGSGSPHSKAQNQQT | 3398 | 58.374 | 0.000 | 0.046 | 0.000 | 0.088 | 0.326 | 128.675 |
| KTIIGSGSPHSKAQDRQT | 3399 | 58.258 | 1.393 | 0.230 | 0.219 | 0.000 | 0.045 | 53.981 |
| KSDKGSGSPHSKAQNQQT | 3400 | 58.248 | 0.000 | 0.000 | 0.000 | 0.076 | 0.166 | 146.566 |
| KTEQVSGSPHSKAQNQQT | 3401 | 58.247 | 0.000 | 0.000 | 0.000 | 0.000 | 0.081 | 88.487 |
| KTEHVSGSPHSKAQNQQT | 3402 | 58.228 | 0.000 | 0.024 | 0.000 | 0.433 | 0.141 | 71.410 |
| KTINGSGSPHSKARDWQT | 3403 | 58.216 | 0.000 | 0.005 | 0.000 | 0.800 | 0.259 | 120.704 |
| KTENASGSPHSKAQNQQT | 3404 | 58.187 | 0.000 | 0.038 | 0.000 | 0.371 | 0.129 | 88.439 |
| KEVQGSGSPHSKAQNQQT | 3405 | 58.125 | 0.000 | 0.000 | 0.000 | 0.657 | 0.000 | 168.220 |
| KTINGSGSPHSKAQNTHD | 3406 | 58.108 | 0.000 | 0.027 | 0.000 | 0.410 | 0.126 | 81.189 |
| KTINGSGSPHSKAPNLQI | 3407 | 58.022 | 0.000 | 0.044 | 0.000 | 1.548 | 0.243 | 55.714 |
| KTINGSGSPHSKAQERST | 3408 | 58.021 | 0.000 | 0.01 | 0.005 | 0.829 | 0.409 | 87.656 |
| KTSNGSGSPHSKAQNYQT | 3409 | 57.894 | 0.000 | 0.082 | 0.000 | 0.000 | 0.110 | 63.681 |
| KTEYISGSPHSKAQNQQT | 3410 | 57.891 | 0.000 | 0.000 | 0.000 | 0.076 | 0.075 | 57.620 |
| KTINGSGSPHSKAQRTCT | 3411 | 57.863 | 0.000 | 0.140 | 0.129 | 1.855 | 1.716 | 90.146 |
| KTINGSGSPHSKAQIGHT | 3412 | 57.769 | 0.024 | 0.000 | 0.000 | 0.281 | 0.154 | 99.262 |
| KNCWGSGSPHSKAQNQQT | 3413 | 57.756 | 0.000 | 0.000 | 0.000 | 0.000 | 0.092 | 59.888 |
| KTINGSGSPHSKAQGAIT | 3414 | 57.627 | 0.000 | 0.000 | 0.000 | 0.594 | 0.161 | 95.696 |
| KTDVNSGSPHSKAQNQQT | 3415 | 57.593 | 0.000 | 0.000 | 0.000 | 0.000 | 0.331 | 66.127 |
| KSDIGSGSPHSKAQNQQT | 3416 | 57.592 | 0.000 | 0.000 | 0.000 | 0.844 | 0.128 | 107.342 |
| KTINGSGSPHSKAQVPPT | 3417 | 57.316 | 0.000 | 0.012 | 0.000 | 0.257 | 0.200 | 90.220 |
| KTINGSGSPHSKAQVQQI | 3418 | 57.308 | 0.000 | 1.113 | 0.000 | 0.000 | 0.113 | 61.957 |
| KTINGSGSPHSKALMRQT | 3419 | 57.234 | 0.060 | 0.036 | 0.100 | 1.798 | 0.517 | 81.332 |
| KTINGSGSPHSKAQYSVT | 3420 | 57.130 | 0.000 | 0.093 | 0.000 | 1.235 | 0.302 | 60.023 |
| KNSIGSGSPHSKAQNQQT | 3421 | 57.101 | 0.000 | 0.052 | 0.000 | 0.083 | 0.074 | 97.381 |
| KTINGSGSPHSKVPNLQT | 3422 | 57.046 | 0.000 | 0.029 | 0.000 | 0.459 | 0.082 | 50.474 |
| KAINGSGSPHSKAQSQQI | 3423 | 56.976 | 0.000 | 0.000 | 0.000 | 0.000 | 0.000 | 57.052 |
| KTINGSGSPHSKAQAITT | 3424 | 56.924 | 0.000 | 0.000 | 0.000 | 1.239 | 0.438 | 75.250 |
| KTINGSGSPHSKAQKTLT | 3425 | 56.844 | 0.000 | 0.017 | 0.009 | 1.800 | 1.400 | 66.415 |
| KTVNGSGSPHSKAQNQWT | 3426 | 56.823 | 0.000 | 0.000 | 0.299 | 0.000 | 0.219 | 69.906 |
| KTINGSGSPHSKAQLHHT | 3427 | 56.815 | 0.025 | 0.000 | 0.010 | 0.712 | 0.368 | 58.418 |
| KTEQTSGSPHSKAQNQQT | 3428 | 56.683 | 0.000 | 0.045 | 0.000 | 0.792 | 0.430 | 59.360 |
| KTINGSGSPHSKAQNIII | 3429 | 56.630 | 0.000 | 0.062 | 0.123 | 0.099 | 0.056 | 76.742 |
| KNSLGSGSPHSKAQNQQT | 3430 | 56.621 | 0.000 | 0.028 | 0.000 | 0.308 | 0.162 | 101.942 |

TABLE 15-continued

NGS fold-enrichment of TTM-001 and TTM-002 matured AAV capsid variants in th ebrain of NHPs and mice

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KTIPMEGSPHSKAQNQQT | 3567 | 56.560 | 0.000 | 0.000 | 0.000 | 1.824 | 0.371 | 89.951 |
| KTINGSGSPHSKAQGHHT | 3431 | 56.559 | 0.000 | 0.000 | 0.000 | 0.632 | 0.117 | 71.050 |
| KTDRTSGSPHSKAQNQQT | 3432 | 56.466 | 0.000 | 0.000 | 0.000 | 0.062 | 0.160 | 148.498 |
| KTINGSGSPHSKAQSKVT | 3433 | 56.373 | 0.000 | 0.050 | 0.014 | 1.021 | 0.390 | 76.115 |
| KEVVGSGSPHSKAQNQQT | 3434 | 56.371 | 0.000 | 0.000 | 0.000 | 0.000 | 0.323 | 116.964 |
| KTINGSGSPHSKAQLPST | 3435 | 56.238 | 0.005 | 4.258 | 0.001 | 1.040 | 0.185 | 84.918 |
| KTINGSGSPHSKAIGKQT | 3436 | 56.158 | 0.000 | 0.000 | 0.000 | 0.887 | 0.088 | 110.132 |
| KTEPTSGSPHSKAQNQQT | 3437 | 56.134 | 0.000 | 0.000 | 0.000 | 0.061 | 0.527 | 143.397 |
| KTVNGGGSPHSKSQNQQT | 3568 | 56.114 | 0.116 | 0.000 | 0.000 | 0.000 | 0.040 | 170.548 |
| KTINGSGSPHSKAQAIHT | 3438 | 56.047 | 0.000 | 0.000 | 212.32 | 0.887 | 0.890 | 81.908 |
| KTINGSGSPHSKAQHGLT | 3439 | 55.999 | 0.000 | 0.000 | 0.101 | 1.913 | 0.244 | 117.191 |
| KSELGSGSPHSKAQNQQT | 3440 | 55.997 | 0.000 | 0.005 | 0.000 | 0.881 | 0.239 | 120.521 |
| KTINGSGSPHSKAQFMCT | 3441 | 55.916 | 0.000 | 0.000 | 0.000 | 0.078 | 0.448 | 81.959 |
| KTINVSGSPHSKAQGQQT | 3442 | 55.870 | 0.000 | 0.191 | 0.000 | 0.592 | 0.040 | 87.211 |
| KTINGGGSPHSKAQNQMT | 3569 | 55.778 | 0.000 | 0.000 | 0.000 | 0.866 | 0.012 | 73.177 |
| KTVNGSGSPHSKAQHLQT | 3443 | 55.739 | 0.091 | 0.036 | 0.000 | 0.062 | 0.409 | 62.743 |
| KTIRENGSPHSKAQNQQT | 3570 | 55.605 | 0.000 | 0.000 | 0.016 | 0.131 | 0.257 | 95.931 |
| KTINGSGSPHSKTQNHQN | 3444 | 55.551 | 0.000 | 0.048 | 0.000 | 0.000 | 0.099 | 64.846 |
| KTINGSGSPHSKAQPART | 3445 | 55.513 | 0.000 | 0.000 | 0.328 | 1.294 | 0.991 | 127.301 |
| KTVNGSGSPHSKAQSLQT | 3446 | 55.497 | 0.000 | 0.060 | 0.000 | 0.000 | 0.143 | 69.033 |
| KTINGSGSPHSKSQSQLT | 3447 | 55.430 | 0.000 | 0.035 | 0.000 | 0.050 | 0.013 | 125.577 |
| KTINGSASPHSKAHSQQT | 3571 | 55.293 | 0.000 | 0.000 | 0.000 | 0.000 | 0.166 | 66.252 |
| KTWQNSGSPHSKAQNQQT | 3448 | 55.245 | 0.000 | 0.000 | 0.000 | 0.111 | 0.265 | 114.258 |
| KTINGSGSPHSKAQDRQS | 3449 | 55.137 | 1.146 | 0.016 | 0.106 | 0.644 | 0.086 | 55.701 |
| KTINGSGSPHSKAQMPST | 3450 | 54.986 | 1.691 | 0.039 | 0.028 | 0.450 | 0.202 | 114.331 |
| KTNNGGGSPHSKAQNLQT | 3572 | 54.963 | 0.000 | 0.000 | 0.000 | 0.000 | 0.089 | 80.506 |
| KTINGSGSPHSKAQGSLT | 3451 | 54.717 | 0.000 | 0.006 | 0.013 | 0.480 | 0.298 | 142.786 |
| KTEVTSGSPHSKAQNQQT | 3452 | 54.663 | 0.000 | 0.000 | 0.000 | 0.323 | 0.185 | 81.482 |
| KSINGGGSPHSKAQYQQT | 3573 | 54.612 | 0.000 | 0.000 | 0.000 | 0.105 | 0.010 | 65.952 |
| KTVIGSGSPHSKSQNQQT | 3453 | 54.603 | 0.000 | 0.000 | 0.000 | 0.000 | 0.106 | 69.121 |
| KAVNVSGSPHSKAQNQQT | 3454 | 54.586 | 0.000 | 0.000 | 0.000 | 0.000 | 0.023 | 57.835 |
| KTVNGNGSPHSKSQNQQT | 3574 | 54.586 | 0.000 | 0.000 | 0.000 | 0.256 | 0.168 | 95.384 |
| KTDRNSGSPHSKAQNQQT | 3455 | 54.495 | 0.000 | 0.000 | 0.000 | 0.823 | 0.241 | 85.823 |
| KTINGSGSPHSKAQVPAT | 3456 | 54.475 | 0.000 | 0.002 | 0.000 | 0.782 | 0.223 | 137.743 |
| KGVLGSGSPHSKAQNQQT | 3457 | 54.472 | 0.000 | 0.007 | 0.027 | 0.359 | 0.189 | 145.740 |

TABLE 15-continued

NGS fold-enrichment of TTM-001 and TTM-002 matured AAV capsid variants in th ebrain of NHPs and mice

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KTLNGNGSPHSKAQNLQT | 3575 | 54.458 | 0.668 | 0.000 | 0.000 | 0.161 | 0.172 | 159.134 |
| KAINGSGSPHSKAQDKQT | 3458 | 54.452 | 0.000 | 0.000 | 0.057 | 0.044 | 0.223 | 56.004 |
| KTSNGSGSPHSKAHYQQT | 3459 | 54.414 | 0.000 | 0.251 | 0.000 | 0.249 | 0.204 | 54.162 |
| KTINGSGSPHSKAQVPST | 3460 | 54.366 | 0.000 | 1.001 | 0.000 | 0.202 | 0.139 | 117.223 |
| KTINGSGSSHSKAQNQQT | 3576 | 54.292 | 1.709 | 1.870 | 1.287 | 1.075 | 0.458 | 67.731 |
| KTELRSGSPHSKAQNQQT | 3461 | 54.289 | 0.000 | 0.007 | 0.040 | 0.790 | 0.239 | 57.814 |
| KNINGSGSPHSKAQNHQT | 3462 | 54.248 | 0.000 | 0.034 | 0.000 | 0.340 | 0.075 | 74.979 |
| KTVNGGGSPHSKAQNHQT | 3577 | 54.246 | 0.375 | 0.024 | 0.000 | 0.000 | 0.146 | 67.188 |
| KTINGSGSPHSKARGEQT | 3463 | 54.207 | 0.025 | 0.006 | 0.005 | 0.309 | 0.327 | 128.098 |
| KTINGGGSPHSKAQYQHT | 3578 | 54.188 | 0.000 | 0.000 | 0.000 | 0.000 | 0.223 | 82.256 |
| KTEDLSGSPHSKAQNQQT | 3464 | 54.156 | 0.000 | 0.000 | 0.000 | 1.193 | 0.132 | 70.198 |
| KTINGSGSPHSKAPGQQT | 3465 | 54.071 | 0.065 | 0.000 | 0.004 | 0.542 | 0.179 | 73.440 |
| KTIPKNGSPHSKAQNQQT | 3579 | 53.824 | 0.000 | 0.032 | 0.000 | 0.115 | 0.178 | 77.458 |
| KTINGSGSPHSKAQSLQI | 3466 | 53.778 | 0.000 | 0.186 | 0.000 | 0.022 | 0.047 | 51.543 |
| KTINGSGSPHSKRLEQQT | 3467 | 53.512 | 0.000 | 0.118 | 0.003 | 0.161 | 0.292 | 71.704 |
| KTERGSGSPHSKAQNQQT | 3468 | 53.475 | 0.000 | 0.030 | 0.000 | 1.416 | 0.175 | 85.368 |
| KTVNGSGSPHSKAPNQQT | 3469 | 53.444 | 0.833 | 2.206 | 0.006 | 0.156 | 0.178 | 58.080 |
| KTSNGSGSPHSKAQNQST | 3470 | 53.353 | 0.000 | 0.000 | 0.000 | 0.000 | 0.014 | 120.897 |
| KTINGSGSPHSKAQKVIT | 3471 | 53.273 | 0.000 | 0.000 | 0.000 | 0.357 | 0.402 | 95.147 |
| KTEGISGSPHSKAQNQQT | 3472 | 53.270 | 0.000 | 0.000 | 0.000 | 0.000 | 0.010 | 78.303 |
| KTINGSGSPHSKAQNNDQ | 3473 | 53.226 | 0.000 | 0.000 | 0.000 | 0.593 | 0.046 | 59.664 |
| KTINGSGSPHSKAQSVHT | 3474 | 53.226 | 0.000 | 0.004 | 0.000 | 0.446 | 0.217 | 76.110 |
| KTINGSGSPHSKAQPLGT | 3475 | 53.049 | 0.015 | 0.004 | 0.001 | 0.515 | 0.222 | 68.656 |
| KTINKEGSPHSKAQNQQT | 3580 | 53.006 | 0.000 | 0.029 | 0.000 | 0.177 | 0.111 | 64.520 |
| KTCNASGSPHSKAQNQQT | 3476 | 52.998 | 0.000 | 0.011 | 0.000 | 0.897 | 0.141 | 67.934 |
| KAINGSGSPHSKAHNQET | 3477 | 52.973 | 0.000 | 0.030 | 0.000 | 0.035 | 0.058 | 71.809 |
| KTEGLSGSPHSKAQNQQT | 3478 | 52.891 | 0.000 | 0.000 | 0.020 | 0.104 | 0.155 | 104.529 |
| KTRDASGSPHSKAQNQQT | 3479 | 52.861 | 0.000 | 0.000 | 0.010 | 1.062 | 0.402 | 52.089 |
| KTSNGSGSPHSKAQNLQI | 3480 | 52.843 | 0.000 | 0.000 | 1.605 | 0.178 | 0.214 | 74.823 |
| KTGNGSGSPHSKAQIQQT | 3481 | 52.809 | 0.000 | 0.000 | 0.000 | 0.000 | 0.012 | 98.291 |
| KTVNGGGSPHSKAQNLQT | 3581 | 52.788 | 0.000 | 0.031 | 0.000 | 0.000 | 0.165 | 83.215 |
| KTDRSSGSPHSKAQNQQT | 3482 | 52.737 | 0.000 | 0.000 | 0.000 | 0.995 | 0.085 | 123.421 |
| KTINGSGSPHSKAQVRNT | 3483 | 52.735 | 0.000 | 0.101 | 0.011 | 0.230 | 0.423 | 68.893 |
| KTINGSGSPHSKAPSNQT | 3484 | 52.680 | 1.494 | 4.762 | 0.003 | 0.330 | 0.208 | 87.951 |
| KTINGSGSPHSKAQVGHT | 3485 | 52.624 | 0.000 | 0.000 | 0.006 | 0.535 | 0.192 | 106.448 |
| KNAIGSGSPHSKAQNQQT | 3486 | 52.516 | 0.000 | 0.000 | 0.000 | 0.165 | 0.198 | 117.939 |

TABLE 15-continued

NGS fold-enrichment of TTM-001 and TTM-002 matured AAV capsid variants in th ebrain of NHPs and mice

| Sequence | SEQ ID NO: | Fold Enrichment relative to AAV9 | | | | | | |
| --- | --- | --- | --- | --- | --- | --- | --- | --- |
| | | Brain (NHP) | DRG (NHP) | Heart (NHP) | Muscle (NHP) | Liver RNA (NHP) | Liver DNA (NHP) | Brain (Mouse) |
| KAENGSGSPHSKAQNQQT | 3487 | 52.487 | 0.000 | 0.157 | 0.029 | 0.000 | 0.242 | 120.256 |
| KTINGSGSPHSKAQRDIT | 3488 | 52.415 | 0.098 | 0.000 | 0.008 | 1.784 | 0.605 | 88.122 |
| KTINGSGSPHSKAQMPNT | 3489 | 52.408 | 0.084 | 0.036 | 0.025 | 0.057 | 0.359 | 66.040 |
| KTVNGSGSPHSKSQNQQT | 3490 | 52.395 | 0.033 | 0.077 | 0.013 | 0.105 | 0.175 | 58.000 |
| KTIPAIGSPHSKAQNQQT | 3582 | 52.346 | 0.000 | 0.009 | 0.000 | 0.034 | 0.134 | 51.949 |
| KTINGSGSPHSKARGLQT | 3491 | 52.275 | 0.000 | 0.000 | 0.036 | 1.235 | 1.425 | 169.881 |
| KTELGSGSPHSKAQNQQT | 3492 | 52.232 | 0.000 | 0.007 | 0.006 | 0.532 | 0.088 | 87.314 |
| KAETGSGSPHSKAQNQQT | 3493 | 52.219 | 0.000 | 0.047 | 0.581 | 0.009 | 0.188 | 132.940 |
| KTINGSGSPHSKLQKQQT | 3494 | 52.144 | 0.615 | 0.477 | 1.071 | 1.113 | 0.429 | 61.833 |
| KTINGSGSPHSKAPSLQT | 3495 | 52.137 | 0.041 | 1.614 | 0.002 | 0.902 | 0.222 | 70.363 |
| KTINGSGSPHSKAQRDQT | 3496 | 51.897 | 0.069 | 0.014 | 0.040 | 0.867 | 0.554 | 102.317 |
| KTDVGSGSPHSKAQNQQT | 3497 | 51.849 | 0.000 | 0.007 | 0.000 | 0.385 | 0.560 | 115.774 |
| KTINGSGSPHSKNRDQQT | 3498 | 51.830 | 0.000 | 0.008 | 0.000 | 0.480 | 0.138 | 100.300 |
| KSINGSGSPHSKAPNLQT | 3499 | 51.812 | 0.000 | 0.256 | 0.000 | 0.085 | 0.139 | 59.270 |
| KTINGSGSPHSKAQAKGT | 3500 | 51.727 | 0.048 | 0.016 | 0.000 | 0.271 | 0.525 | 104.917 |
| KTVNGSGSPHSKAQDKQT | 3501 | 51.580 | 0.428 | 0.000 | 0.069 | 0.041 | 0.063 | 69.225 |
| KTINGGSPHSKAQNPQA | 3583 | 51.574 | 0.000 | 0.000 | 0.000 | 0.192 | 0.000 | 102.792 |
| KTINGSGSPHSKAQSAHT | 3502 | 51.569 | 0.068 | 0.070 | 0.000 | 0.589 | 0.249 | 79.498 |
| KTINGNGSPHSKSQNQHT | 3584 | 51.379 | 0.000 | 0.054 | 0.000 | 0.000 | 0.082 | 56.614 |
| KTVPTSGSPHSKAQNQQT | 3503 | 51.348 | 0.013 | 0.000 | 0.000 | 1.017 | 0.338 | 102.651 |
| KTIDGSGSPHSKSQNHQT | 3504 | 51.307 | 0.000 | 0.000 | 0.000 | 0.000 | 0.269 | 63.174 |
| KTDVKSGSPHSKAQNQQT | 3505 | 51.296 | 0.000 | 0.000 | 0.000 | 0.515 | 0.224 | 53.601 |
| KAINRSGSPHSKAQDQQT | 3506 | 51.262 | 0.000 | 0.000 | 0.000 | 0.000 | 0.036 | 54.631 |
| KTINGSGSPHSKAQSTMT | 3507 | 51.249 | 0.018 | 0.002 | 0.002 | 0.321 | 0.341 | 73.213 |
| KTVNASGSPHSKAQNQLT | 3508 | 51.249 | 0.000 | 0.000 | 0.000 | 0.000 | 0.268 | 99.559 |
| KTINGSGSPHSKAQREMT | 3509 | 51.076 | 0.000 | 24.900 | 143.49 | 1.564 | 0.476 | 70.961 |
| KTVHGSGSPHSKAQSQQT | 3510 | 51.057 | 0.000 | 0.000 | 0.000 | 0.143 | 0.146 | 54.185 |
| KTINGGSPHSKSQNRQT | 3585 | 51.017 | 0.000 | 0.000 | 0.000 | 0.000 | 0.421 | 149.370 |
| KTINGSGSPHSKAQYRAT | 3511 | 51.008 | 0.000 | 0.158 | 0.000 | 0.690 | 0.120 | 50.650 |
| KTINGGSPHSKAQRQQT | 3586 | 50.998 | 0.000 | 0.041 | 0.000 | 0.991 | 0.142 | 147.942 |
| KTEPMSGSPHSKAQNQQT | 3512 | 50.960 | 0.203 | 0.000 | 0.000 | 1.816 | 0.415 | 126.322 |
| KTINGSGSPHSKNQWQQT | 3513 | 50.800 | 0.000 | 0.044 | 0.047 | 0.111 | 0.324 | 65.506 |
| KETAGSGSPHSKAQNQQT | 3514 | 50.762 | 0.000 | 0.027 | 0.000 | 1.706 | 0.054 | 212.795 |
| KTINGSGSPHSKAQRMNT | 3515 | 50.686 | 0.000 | 108.747 | 0.019 | 0.943 | 0.264 | 97.975 |
| KNNLGSGSPHSKAQNQQT | 3516 | 50.670 | 0.000 | 0.019 | 0.000 | 0.406 | 0.121 | 102.408 |

TABLE 15-continued

NGS fold-enrichment of TTM-001 and TTM-002 matured AAV capsid variants in th ebrain of NHPs and mice

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KTINGSGSPHAKAQNHQT | 3517 | 50.667 | 0.211 | 0.140 | 0.051 | 0.101 | 0.090 | 80.603 |
| KTIIKNGSPHSKAQNQQT | 3587 | 50.587 | 0.000 | 0.000 | 0.000 | 0.000 | 0.751 | 75.547 |
| KTINGSGSPHSYHVNQQT | 3588 | 50.486 | 0.000 | 0.056 | 0.059 | 0.528 | 0.275 | 179.489 |
| KTINGSGSPHSKAGDSQT | 3518 | 50.457 | 0.614 | 0.236 | 0.008 | 1.062 | 0.071 | 74.355 |
| KTINGSGSPHSKLKSQQT | 3519 | 50.368 | 0.000 | 0.296 | 0.000 | 1.796 | 1.096 | 95.240 |
| KTINGSGSPHSKAQKIST | 3520 | 50.285 | 0.000 | 0.000 | 0.088 | 0.108 | 0.302 | 51.115 |
| KTEYNSGSPHSKAQNQQT | 3521 | 50.256 | 0.000 | 0.000 | 0.000 | 0.000 | 0.009 | 62.679 |
| KTINGSGSPHSKAPSMQT | 3522 | 50.249 | 0.000 | 0.000 | 0.004 | 0.941 | 0.460 | 75.504 |
| EAINGSGSPHSKAQNQQT | 3523 | 50.243 | 0.629 | 0.094 | 0.000 | 0.057 | 1.519 | 117.305 |
| KTINGSGSPHSKASPRQT | 3524 | 50.227 | 0.088 | 0.005 | 0.068 | 1.761 | 0.530 | 67.241 |
| KTINGSGSPHSKRMEQQT | 3525 | 50.177 | 0.000 | 0.000 | 0.000 | 1.327 | 0.208 | 81.769 |
| KTINGSGSPHSKAQYQNT | 3526 | 50.099 | 0.000 | 0.008 | 0.000 | 0.017 | 0.119 | 71.846 |
| KTERVSGSPHSKAQNQQT | 3589 | 96.943 | 0.000 | 0.000 | 0.000 | 0.000 | 0.144 | 135.438 |
| KAEIGHDSPHKSGQNQQT | 1754 | 63.249 | 0.000 | 0.000 | 0.000 | 0.060 | 0.024 | 27.173 |

Table 16 provides the peptide sequence of 341 matured capsid variants, and the fold enrichment of these matured capsid variants relative to the AAV9 control that demonstrated a 75-fold or greater increase in expression in the brain of NHPs relative to the AAV9 control and had a fold-change in expression that was less than 2 relative to the AAV9 control in the liver and the DRG.

TABLE 16

NGS fold-enrichment of TTM-001 and TTM-002 matured AAV capsid variants in the brain of NHPs

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KTFNRSGSPHSKAQNQQI | 3591 | 86.359 | 0.000 | 113.67 | 0.000 | 0.000 | 0.092 | 25.568 |
| KTIIGSGSPHSKAQNRHT | 3239 | 217.176 | 0.000 | 0.000 | 0.000 | 0.000 | 0.000 | 210.515 |
| KTFPGSGSPHSKVQNQQT | 3240 | 199.720 | 0.000 | 0.000 | 0.000 | 0.000 | 0.967 | 97.703 |
| KTEKMSGSPHSKAQNQQT | 3241 | 169.461 | 0.523 | 0.000 | 0.000 | 0.000 | 0.158 | 109.161 |
| KAINGHDSPHKSGQIRQT | 3606 | 108.510 | 0.000 | 23.908 | 0.000 | 0.132 | 0.261 | 8.862 |
| KTINGHDSPHKIGQNQHA | 3607 | 77.321 | 0.000 | 18.836 | 0.028 | 0.220 | 0.132 | 7.578 |
| KEINGRGSPHSKAQNQQT | 3527 | 134.390 | 0.239 | 0.000 | 0.000 | 0.000 | 0.232 | 52.311 |
| KTVNRNGSPHSKAQNQQT | 3528 | 133.016 | 0.000 | 0.416 | 0.000 | 0.000 | 0.000 | 85.361 |
| KAINGYDSPHKSGQKQQT | 3608 | 83.803 | 0.041 | 9.491 | 0.000 | 0.031 | 0.150 | 13.057 |
| KTVNGSGSPHSKARDQQT | 3242 | 124.789 | 0.123 | 0.039 | 0.312 | 0.569 | 0.454 | 132.137 |

TABLE 16-continued

NGS fold-enrichment of TTM-001 and TTM-002 matured AAV capsid variants in the brain of NHPs

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KTESGHDSPHKSGQNQQT | 3609 | 86.513 | 0.000 | 7.414 | 0.000 | 0.000 | 0.038 | 13.163 |
| KTINGHDSPHKSGQSVQT | 3610 | 75.748 | 0.010 | 6.808 | 0.000 | 0.165 | 0.058 | 9.321 |
| KTFNGSGSPHSKAPNLQT | 3243 | 121.436 | 0.000 | 0.167 | 0.000 | 0.000 | 0.015 | 168.920 |
| KTEKTSGSPHSKAQNQQT | 3244 | 120.337 | 0.000 | 0.355 | 0.000 | 0.000 | 0.119 | 101.467 |
| TTINGHDSPHKSGQNQQT | 3611 | 108.963 | 1.512 | 3.445 | 0.869 | 0.659 | 1.109 | 14.788 |
| KTINGHESPHKSGRSQQT | 3612 | 97.106 | 0.000 | 3.329 | 0.022 | 0.000 | 0.181 | 9.378 |
| KTINGSGSPHSKAHVRQT | 3245 | 119.798 | 0.000 | 0.000 | 0.262 | 0.694 | 1.039 | 165.590 |
| KTVNGSGSPHSKAPNQHT | 3246 | 117.207 | 0.000 | 0.109 | 0.000 | 0.000 | 0.074 | 51.008 |
| KTEKISGSPHSKAQNQQT | 3247 | 116.603 | 0.000 | 0.000 | 0.000 | 0.000 | 0.426 | 102.978 |
| KTINGPGSPHSKAHNQQT | 3529 | 115.742 | 0.146 | 0.000 | 0.235 | 0.000 | 0.513 | 52.508 |
| KTINGHDSPHKSGQNKLE | 3613 | 76.204 | 0.000 | 1.430 | 0.000 | 0.015 | 0.031 | 12.419 |
| KTVNGSGSPHSKTQSQQT | 3248 | 115.086 | 0.000 | 0.726 | 0.000 | 0.000 | 0.340 | 63.248 |
| TTINGSGSPHSKAQNQQT | 3249 | 114.856 | 1.340 | 14.856 | 0.827 | 1.281 | 0.957 | 72.058 |
| KSINESGSPHSKAQNQQI | 3250 | 113.833 | 0.000 | 0.000 | 0.000 | 0.000 | 0.000 | 67.649 |
| KTINGHDSPHKTGQNQQK | 3614 | 77.562 | 0.000 | 1.056 | 0.000 | 0.000 | 0.000 | 6.379 |
| KTERTSGSPHSKAQNQQT | 3251 | 112.957 | 0.000 | 0.009 | 0.000 | 1.128 | 0.207 | 117.374 |
| KTINGSGSPHSKAQPAKT | 3252 | 111.472 | 0.331 | 0.000 | 1.089 | 0.044 | 1.796 | 215.275 |
| KTINGRGSPHKRGQNQQT | 3837 | 120.889 | 0.100 | 0.814 | 0.434 | 0.458 | 0.614 | 13.988 |
| KTINGSGSPHTKAQNPPT | 3592 | 147.061 | 0.000 | 0.727 | 0.000 | 0.000 | 0.000 | 34.425 |
| KTEKSSGSPHSKAQNQQT | 3253 | 107.470 | 0.000 | 0.016 | 0.014 | 0.977 | 0.179 | 100.177 |
| KAINGHDNPHKSGQNQQT | 3615 | 88.906 | 0.297 | 0.721 | 0.482 | 0.222 | 0.130 | 9.702 |
| KTSYGNGSPHSKAQNQQT | 3530 | 105.937 | 0.000 | 0.000 | 0.000 | 0.000 | 0.114 | 105.894 |
| KTINGQDSPHKSGQHQQA | 3616 | 85.657 | 1.127 | 0.579 | 0.000 | 0.193 | 0.557 | 5.582 |
| KTEKGSGSPHSKAQNQQT | 3254 | 105.614 | 0.053 | 0.031 | 0.000 | 0.586 | 0.169 | 84.653 |
| KTINGSGSPHSKSQTQQN | 3255 | 104.474 | 0.000 | 0.131 | 0.000 | 0.084 | 0.038 | 54.021 |
| KTERISGSPHSKAQNQQT | 3256 | 103.692 | 0.000 | 0.000 | 0.000 | 0.062 | 0.370 | 89.637 |
| KTERASGSPHSKAQNQQT | 3257 | 103.669 | 0.000 | 0.000 | 0.000 | 0.127 | 0.070 | 115.550 |
| KSINGHDSPHKSGQIQHT | 3617 | 87.598 | 0.000 | 0.480 | 0.000 | 0.714 | 0.347 | 13.872 |
| KELHGSGSPHSKAQNQQT | 3258 | 102.680 | 0.000 | 0.000 | 0.000 | 1.634 | 0.592 | 96.554 |
| KAINGSGSPHSKAQNLAT | 3259 | 101.954 | 0.000 | 10.954 | 8.655 | 0.298 | 0.239 | 116.685 |
| KTVNGSGSPHSKSQNQLT | 3260 | 101.327 | 0.000 | 0.035 | 0.000 | 0.000 | 0.025 | 80.716 |
| KAINGHDSPHKSGPRQQT | 3618 | 145.142 | 0.000 | 0.408 | 0.000 | 0.000 | 0.000 | 8.259 |
| KTVNGHDSPHKSGHTQQT | 3619 | 82.246 | 0.000 | 0.378 | 1.142 | 0.000 | 0.123 | 6.160 |
| KSINGHDSPHKSGQRQHT | 3620 | 80.132 | 0.000 | 0.357 | 0.000 | 0.000 | 0.000 | 9.851 |
| KTERNSGSPHSKAQNQQT | 3261 | 99.892 | 0.000 | 0.000 | 0.000 | 0.000 | 0.107 | 87.392 |
| KSLNGSGSPHTKAQNQQT | 3593 | 81.515 | 0.197 | 0.333 | 0.000 | 0.000 | 0.085 | 45.140 |

TABLE 16-continued

NGS fold-enrichment of TTM-001 and TTM-002 matured AAV capsid variants in the brain of NHPs

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KSVNGNGSPHSKAQNQQT | 3531 | 99.385 | 0.000 | 1.329 | 0.000 | 0.359 | 0.079 | 51.016 |
| KAINGHDSPHKSAQSQQT | 3621 | 95.204 | 0.146 | 0.310 | 0.000 | 0.699 | 0.058 | 14.595 |
| KSIYGHESPHKSGQNQQS | 3622 | 90.947 | 0.817 | 0.310 | 0.000 | 0.000 | 0.243 | 8.064 |
| KTFNGSGSPHSKAQGQQT | 3262 | 99.253 | 0.000 | 0.208 | 0.000 | 0.128 | 0.099 | 81.459 |
| KTVNGHDSPHKSLQNQQT | 3623 | 112.925 | 0.000 | 0.301 | 0.059 | 0.000 | 0.322 | 16.726 |
| KTINGSGSPHGWVQNQQT | 3532 | 97.122 | 0.000 | 0.000 | 0.000 | 1.240 | 1.975 | 290.720 |
| KTINGHGSPHSKAQNPQT | 3838 | 83.478 | 0.000 | 0.288 | 0.219 | 0.000 | 0.260 | 11.001 |
| KTSNGYDSPHKSGQKQQT | 3624 | 77.001 | 0.032 | 0.286 | 0.000 | 0.000 | 0.016 | 8.813 |
| KTVNGHDSPHKSGRNQET | 3625 | 102.695 | 0.000 | 0.286 | 0.000 | 0.000 | 0.027 | 11.958 |
| KTTNGHDSPHKSGQTQLT | 3626 | 115.637 | 0.000 | 0.283 | 0.000 | 0.052 | 0.321 | 17.885 |
| KAINGHDSPHKSEKNQQT | 3627 | 77.103 | 0.000 | 0.274 | 0.000 | 0.000 | 0.000 | 26.868 |
| KTERVSGSPHSKAQNQQT | 3263 | 96.943 | 0.000 | 0.000 | 0.000 | 0.000 | 0.144 | 135.438 |
| KTINGSGSPHSKALNRQS | 3264 | 96.843 | 0.136 | 0.532 | 0.000 | 0.042 | 0.178 | 55.945 |
| KTERLSGSPHSKAQNQQT | 3265 | 95.857 | 0.000 | 0.004 | 0.005 | 0.126 | 0.260 | 102.372 |
| KIINGRDSPHKSGQDQQT | 3628 | 78.773 | 0.000 | 0.254 | 0.000 | 0.000 | 0.156 | 16.132 |
| KTDNGSGSPHSKAHNQQT | 3266 | 95.164 | 0.000 | 0.000 | 0.000 | 0.000 | 0.027 | 55.313 |
| KTFHGSGSPHSKTQNQQT | 3267 | 94.714 | 0.000 | 0.210 | 0.120 | 0.000 | 0.000 | 51.119 |
| KTISGHDSPHKTGHNQQT | 3629 | 92.490 | 0.000 | 0.233 | 0.057 | 0.730 | 0.000 | 8.823 |
| KTVNAHDSPHKSGQNQLT | 3630 | 79.137 | 0.000 | 0.233 | 0.178 | 0.753 | 0.045 | 29.254 |
| KTINGGGSPHSKAQTQQI | 3533 | 92.345 | 0.000 | 0.000 | 0.000 | 0.000 | 0.023 | 54.199 |
| KSINGYDSPHKSGQTQQT | 3631 | 79.227 | 1.817 | 0.226 | 0.000 | 0.000 | 1.148 | 4.497 |
| KTINGHESPHKSGQTQQI | 3632 | 86.089 | 0.000 | 0.222 | 0.000 | 0.000 | 0.024 | 3.989 |
| KTINGHDSPHKSGQSKQA | 3633 | 101.460 | 0.000 | 0.222 | 0.000 | 0.185 | 0.114 | 7.510 |
| KTSNGSGSPHSKAQNPPT | 3268 | 91.528 | 0.000 | 0.000 | 0.000 | 0.000 | 0.039 | 51.541 |
| ETINGSGSPHSKAQNLQT | 3269 | 90.969 | 0.221 | 1.023 | 0.197 | 0.179 | 0.813 | 107.216 |
| KTVHGNGSPHSKAQNQQT | 3534 | 90.073 | 0.000 | 0.000 | 0.000 | 0.000 | 0.304 | 97.003 |
| NTINGSGSPHSKAQNQQT | 3270 | 90.017 | 1.712 | 1.261 | 1.171 | 0.923 | 0.540 | 55.179 |
| KTINGGGSPHSKAQNQQC | 3535 | 89.301 | 0.219 | 0.000 | 0.000 | 0.287 | 0.319 | 53.840 |
| KTENMSGSPHSKAQNQQT | 3271 | 89.247 | 0.000 | 0.000 | 0.000 | 0.000 | 0.260 | 130.568 |
| KTENVSGSPHSKAQNQQT | 3272 | 88.506 | 0.000 | 0.000 | 0.000 | 0.964 | 0.112 | 108.591 |
| KTSSGSGSPHSKAQYQQT | 3273 | 87.304 | 0.000 | 0.000 | 0.000 | 0.000 | 0.299 | 58.143 |
| KTIDGGGSPHSKAQNKQT | 3536 | 85.019 | 0.000 | 0.000 | 0.000 | 0.000 | 0.477 | 55.517 |
| KTEKVSGSPHSKAQNQQT | 3274 | 84.558 | 0.000 | 0.022 | 0.000 | 0.873 | 0.424 | 112.185 |
| KAINGSGSPHSKAQDQET | 3275 | 84.080 | 0.000 | 0.000 | 0.000 | 0.194 | 0.027 | 87.637 |
| KTCNKSGSPHSKAQNQQT | 3276 | 83.992 | 0.000 | 0.000 | 0.165 | 0.283 | 0.000 | 119.496 |

TABLE 16-continued

NGS fold-enrichment of TTM-001 and TTM-002 matured AAV capsid variants in the brain of NHPs

| Sequence | SEQ ID NO: | Fold Enrichment relative to AAV9 | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KTINGGGSPHSKAQNQLI | 3537 | 83.881 | 0.000 | 0.000 | 0.000 | 0.046 | 0.387 | 78.383 |
| KNINGGGSPHSKAQNQQT | 3538 | 83.083 | 0.000 | 0.042 | 0.000 | 0.000 | 0.000 | 75.913 |
| KTEHLSGSPHSKAQNQQT | 3277 | 83.080 | 0.000 | 0.000 | 0.012 | 0.021 | 0.189 | 69.494 |
| KAIIGHESPHKSGQNQQT | 3634 | 88.563 | 0.000 | 0.150 | 0.000 | 0.062 | 0.145 | 8.530 |
| KTINGHDSPHKTGQNQPP | 3635 | 77.357 | 0.000 | 0.149 | 0.000 | 0.000 | 0.096 | 8.865 |
| KAINGHDSPHKSGQSPQT | 3636 | 75.734 | 0.095 | 0.148 | 0.000 | 0.000 | 0.238 | 14.195 |
| KAEMGSGSPHSKAQNQQT | 3278 | 83.049 | 0.000 | 0.020 | 0.000 | 0.768 | 0.112 | 135.019 |
| KATNGSGSPHSKAQNHQT | 3279 | 82.627 | 0.000 | 0.176 | 0.000 | 0.155 | 0.057 | 66.207 |
| KTIKGNDSPHKSVQNQQT | 3637 | 85.986 | 0.000 | 0.135 | 0.000 | 0.263 | 0.000 | 8.603 |
| KAIKGSGSPHSKAQDQQT | 3280 | 82.258 | 0.000 | 0.000 | 0.000 | 0.108 | 0.000 | 85.178 |
| KTINGGGSPHSKSQNQLT | 3539 | 82.231 | 0.000 | 0.070 | 0.000 | 0.000 | 0.498 | 126.986 |
| KTEFGHDSPHKSGQNQQT | 3638 | 77.245 | 0.000 | 0.124 | 0.000 | 0.561 | 0.063 | 16.337 |
| KTINGHDSPHKSAQNYQT | 3639 | 130.375 | 0.000 | 0.124 | 0.000 | 0.097 | 0.123 | 19.443 |
| KTFNGSASPHSKALNQQT | 3839 | 84.258 | 0.000 | 0.122 | 0.000 | 0.104 | 0.037 | 31.855 |
| KTINGCGSPHASGQNQQT | 3840 | 132.540 | 0.000 | 0.121 | 0.042 | 0.000 | 0.059 | 1.857 |
| KTINAHDSPHKIGQNHQT | 3640 | 106.832 | 0.000 | 0.121 | 0.000 | 0.000 | 0.231 | 5.074 |
| KTVNGNGSPHSKAQNKQT | 3540 | 81.481 | 0.000 | 0.000 | 0.000 | 0.000 | 0.122 | 69.455 |
| KTINGHESPHKSAQNRQT | 3641 | 95.531 | 0.000 | 0.113 | 0.000 | 0.130 | 0.082 | 4.815 |
| KTINGSGSPHSKGHWQQT | 3281 | 81.434 | 0.000 | 0.000 | 0.000 | 0.000 | 1.011 | 65.252 |
| KTTNGHDSPHKSGQNQQG | 3642 | 85.113 | 0.000 | 0.107 | 0.000 | 0.000 | 0.017 | 10.555 |
| KTIKGQDSPHKIGQNQQT | 3643 | 110.357 | 0.000 | 0.103 | 0.058 | 0.166 | 0.135 | 11.829 |
| KTDKTSGSPHSKAQNQQT | 3282 | 81.430 | 0.000 | 0.000 | 0.000 | 1.362 | 0.291 | 169.515 |
| KTVNGHDSPHKSGQNHLT | 3644 | 81.516 | 0.000 | 0.100 | 0.017 | 0.000 | 0.028 | 16.096 |
| KTFKGSGSPHSKAPNQQT | 3283 | 80.890 | 0.000 | 0.000 | 0.000 | 0.000 | 0.017 | 71.144 |
| KSINGHDSPHKSGQYQHT | 3645 | 88.195 | 0.000 | 0.099 | 0.000 | 0.000 | 0.149 | 14.485 |
| KTINGNDSPHKSVQNHQT | 3646 | 120.002 | 0.000 | 0.099 | 0.788 | 0.000 | 0.000 | 7.920 |
| KTVNGSGSPHSKAQNQLI | 3284 | 80.509 | 0.000 | 0.000 | 0.000 | 0.000 | 0.166 | 71.156 |
| KTINGSGSPHSKRPEQQT | 3285 | 80.418 | 0.000 | 0.013 | 0.000 | 0.149 | 0.361 | 50.319 |
| KTINGSGSPHSKAQRTMT | 3286 | 80.388 | 0.000 | 0.022 | 0.170 | 1.812 | 1.025 | 100.248 |
| KTITGHDSPHKSGQNQWT | 3647 | 81.658 | 0.000 | 0.090 | 0.000 | 0.936 | 0.000 | 7.744 |
| KTNNGHDSPHKSVQNQHT | 3648 | 115.172 | 0.000 | 0.083 | 0.000 | 0.000 | 0.062 | 7.934 |
| KTEKASGSPHSKAQNQQT | 3287 | 80.285 | 0.000 | 0.041 | 0.000 | 0.000 | 0.261 | 90.390 |
| KTIDGHDSPHKSGQNQHA | 3649 | 91.058 | 0.000 | 0.082 | 0.000 | 0.000 | 0.000 | 10.781 |
| KSDQGSGSPHSKAQNQQT | 3288 | 80.076 | 0.000 | 0.000 | 0.000 | 0.993 | 0.124 | 151.911 |
| KTVNGHDSPHKSGQTRQT | 3650 | 133.276 | 0.251 | 0.080 | 0.093 | 0.034 | 0.129 | 7.174 |
| KTVNGHDSPHKSGQNLHT | 3651 | 88.080 | 0.000 | 0.080 | 0.000 | 0.000 | 0.039 | 11.363 |

TABLE 16-continued

NGS fold-enrichment of TTM-001 and TTM-002 matured AAV capsid variants in the brain of NHPs

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KAISGHDSPHKSGLNQQT | 3652 | 78.846 | 0.000 | 0.079 | 0.000 | 0.000 | 0.015 | 11.045 |
| KTEITSGSPHSKAQNQQT | 3289 | 79.620 | 0.000 | 0.163 | 0.000 | 0.332 | 0.074 | 76.686 |
| KTDKSSGSPHSKAQNQQT | 3290 | 79.470 | 0.055 | 0.012 | 0.000 | 1.437 | 0.367 | 141.351 |
| KAINGHDSPHKSAQNQET | 3653 | 90.402 | 0.000 | 0.073 | 0.000 | 0.746 | 0.000 | 10.674 |
| KTITGHDSPHKSGQHLQT | 3654 | 137.945 | 0.000 | 0.072 | 0.000 | 0.000 | 0.000 | 4.187 |
| KTIDGSGSPHSKAQNQQH | 3291 | 79.090 | 0.000 | 0.000 | 0.000 | 0.136 | 0.049 | 57.914 |
| KTVNGNGSPHSKAQNQHT | 3541 | 78.849 | 0.000 | 0.000 | 0.000 | 0.000 | 0.045 | 54.086 |
| KNINGSGSPHSKAQNQQT | 3292 | 78.445 | 0.000 | 0.000 | 0.000 | 0.571 | 0.177 | 89.719 |
| KTINGHDSPHKSRLNQPT | 3655 | 92.883 | 0.000 | 0.070 | 0.050 | 0.904 | 1.075 | 5.598 |
| KTETHSGSPHSKAQNQQT | 3293 | 77.974 | 0.000 | 0.067 | 0.000 | 0.000 | 0.512 | 57.287 |
| KTVDGHDSPHKSGQKQQT | 3656 | 78.802 | 0.000 | 0.069 | 0.000 | 0.157 | 0.342 | 7.200 |
| KTINGQDSPHKSGQNQDT | 3657 | 82.075 | 0.000 | 0.067 | 0.000 | 0.225 | 0.144 | 9.626 |
| KTINGGGSPHSKALNQQN | 3542 | 77.822 | 0.000 | 0.131 | 0.000 | 0.000 | 0.274 | 69.884 |
| KTIEGHDSPHKSGRNQQT | 3658 | 75.838 | 0.000 | 0.065 | 0.017 | 0.000 | 0.079 | 7.818 |
| KTTNGHDSPHKSGQNLLT | 3659 | 77.738 | 0.130 | 0.064 | 0.185 | 0.424 | 0.326 | 15.192 |
| KTINGHDSPHKSGQLVIT | 3660 | 76.781 | 0.089 | 0.064 | 0.000 | 0.338 | 0.475 | 11.323 |
| KTVNGHDSPHKSRQSQQT | 3661 | 76.458 | 0.000 | 0.063 | 0.000 | 0.000 | 0.021 | 8.136 |
| KTINGSGSPHSKALHQHT | 3294 | 77.502 | 0.000 | 0.052 | 0.041 | 0.000 | 0.188 | 68.196 |
| KTINGHDSPHKSGRTQET | 3662 | 81.599 | 0.000 | 0.062 | 0.000 | 0.000 | 0.137 | 7.270 |
| KTINGHDSPHKSVQTHQT | 3663 | 77.309 | 0.237 | 0.062 | 0.000 | 0.000 | 0.116 | 7.519 |
| KTINGTGSPHSKAQNHQI | 3543 | 77.089 | 0.171 | 0.000 | 0.000 | 0.000 | 0.166 | 54.281 |
| KTINGSGSPHSKAQHRIT | 3295 | 76.849 | 0.105 | 0.499 | 0.170 | 1.424 | 0.214 | 127.000 |
| KTINGSGSPHSKAQYIHT | 3296 | 76.170 | 0.000 | 0.014 | 0.033 | 1.523 | 0.168 | 59.649 |
| KTSNGHDSPHKSGQNQPA | 3664 | 75.834 | 0.000 | 0.056 | 0.000 | 0.000 | 0.000 | 8.501 |
| KTEGKHDSPHKSGQNQQT | 3665 | 98.384 | 0.000 | 0.056 | 0.000 | 0.000 | 0.000 | 10.345 |
| KTENISGSPHSKAQNQQT | 3297 | 76.072 | 0.000 | 0.000 | 0.000 | 0.115 | 0.132 | 83.118 |
| KVINGHDSPHKSGQTQQT | 3666 | 91.665 | 0.000 | 0.055 | 1.526 | 0.311 | 0.000 | 7.391 |
| KTIIGGGSPHSKAHNQQT | 3544 | 75.872 | 0.000 | 0.050 | 0.000 | 0.000 | 0.235 | 65.492 |
| KTINGPDSPHKIGQNQQS | 3667 | 85.726 | 0.000 | 0.055 | 0.171 | 0.000 | 0.063 | 10.055 |
| KTINGSGSPHSKAQKFET | 3298 | 75.788 | 0.000 | 0.000 | 0.028 | 0.108 | 0.093 | 65.588 |
| KTSNESGSPHSKAQNHQT | 3299 | 75.720 | 0.000 | 0.000 | 0.000 | 0.169 | 0.217 | 70.590 |
| KTINGSGSPHSKAQFPST | 3300 | 75.677 | 0.000 | 0.004 | 0.000 | 0.849 | 0.127 | 119.712 |
| KTERPSGSPHSKAQNQQT | 3301 | 75.669 | 0.000 | 0.029 | 0.000 | 0.000 | 0.156 | 73.894 |
| KAVNGHDSPHKSVQNQQT | 3668 | 81.051 | 0.448 | 0.051 | 0.000 | 0.665 | 0.091 | 11.288 |
| KTINGNGSPHSKAQNPLT | 3545 | 75.269 | 0.000 | 0.000 | 0.000 | 0.366 | 0.000 | 53.583 |

TABLE 16-continued

NGS fold-enrichment of TTM-001 and TTM-002 matured AAV capsid variants in the brain of NHPs

| | | Fold Enrichment relative to AAV9 | | | | | | |
|---|---|---|---|---|---|---|---|---|
| Sequence | SEQ ID NO: | Brain (NHP) | DRG (NHP) | Heart (NHP) | Muscle (NHP) | Liver RNA (NHP) | Liver DNA (NHP) | Brain (Mouse) |
| KSIKGNGSPHSKAQNQQT | 3546 | 75.196 | 0.000 | 0.000 | 0.000 | 0.000 | 0.000 | 90.251 |
| KTINGHDSPHKSRQDQHT | 3669 | 75.595 | 0.000 | 0.049 | 0.118 | 0.030 | 0.045 | 8.540 |
| KAINGPDSPHKSGQKQQT | 3670 | 78.213 | 0.464 | 0.047 | 0.000 | 0.323 | 0.162 | 10.395 |
| KTINGHDSPHKSRQSQHT | 3671 | 88.544 | 0.499 | 0.046 | 0.000 | 0.059 | 0.032 | 8.324 |
| KTIYGHDSPHKSVQNQLT | 3672 | 92.381 | 0.000 | 0.043 | 0.000 | 0.103 | 0.016 | 12.323 |
| KTVNGHDSPHKSGQNLLT | 3673 | 83.969 | 0.114 | 0.040 | 0.023 | 0.000 | 0.035 | 18.894 |
| KTESAHDSPHKSGQNQQT | 3674 | 80.810 | 0.000 | 0.039 | 0.000 | 0.000 | 0.000 | 13.338 |
| KTENKSGSPHSKAQNQQT | 3594 | 103.854 | 0.000 | 0.037 | 0.000 | 0.000 | 0.119 | 31.182 |
| KTTNGQDSPHKSGQNQQS | 3675 | 92.419 | 0.000 | 0.037 | 0.043 | 0.000 | 0.079 | 7.592 |
| KTDKGSGSPHSKAQNQQT | 3595 | 94.572 | 0.000 | 0.037 | 0.000 | 0.951 | 0.367 | 47.888 |
| KTIDGHDSPHKSGRNQQI | 3676 | 80.240 | 0.000 | 0.037 | 0.000 | 0.040 | 0.144 | 10.363 |
| KTINGYDSPHKSGQYQHT | 3677 | 81.534 | 0.000 | 0.036 | 0.000 | 0.000 | 0.000 | 10.524 |
| KTDNGHDSPHKSRQNQQT | 3678 | 105.312 | 0.000 | 0.033 | 0.000 | 0.000 | 0.018 | 7.931 |
| KTINGHDSPHKSWVRQQT | 3679 | 125.537 | 0.000 | 0.033 | 0.000 | 0.291 | 0.174 | 11.687 |
| KTINGHESPHKSGQNQHS | 3680 | 92.248 | 0.000 | 0.032 | 0.012 | 0.090 | 0.088 | 9.720 |
| KTVNGHDSPHKIGHNQQT | 3681 | 120.985 | 0.000 | 0.029 | 0.000 | 0.000 | 0.009 | 10.167 |
| KTCNGHDSPHKSGRNQQT | 3682 | 94.616 | 0.000 | 0.025 | 0.000 | 0.000 | 0.128 | 12.496 |
| KTINGNGSPHSKAQNHQA | 3841 | 88.274 | 0.000 | 0.024 | 0.000 | 0.000 | 0.041 | 36.754 |
| KNVVGHDSPHKSGQNQQT | 3683 | 75.330 | 0.000 | 0.024 | 0.000 | 0.063 | 0.049 | 8.077 |
| KTELWHDSPHKSGQNQQT | 3684 | 85.323 | 0.057 | 0.020 | 0.000 | 0.000 | 0.243 | 9.915 |
| KTELRHDSPHKSGQNQQT | 3685 | 98.098 | 0.000 | 0.019 | 0.000 | 0.000 | 0.007 | 6.588 |
| KTINGHDSPHKSNAWQQT | 3686 | 84.825 | 0.000 | 0.016 | 0.000 | 0.000 | 0.132 | 15.788 |
| KTDAGHDSPHKSGQNQQT | 3687 | 88.924 | 0.000 | 0.013 | 0.000 | 1.076 | 0.070 | 18.107 |
| KTEVGHDSPHKSGQNQQT | 3688 | 112.457 | 0.000 | 0.011 | 0.000 | 0.000 | 0.138 | 13.125 |
| KTESRHDSPHKSGQNQQT | 3689 | 81.766 | 0.000 | 0.011 | 0.000 | 0.052 | 0.036 | 6.975 |
| KSELGHDSPHKSGQNQQT | 3690 | 107.059 | 0.000 | 0.005 | 0.000 | 0.000 | 0.055 | 13.285 |
| KTINGHDSPHKSGQSVPT | 3691 | 77.840 | 0.000 | 0.003 | 0.000 | 0.136 | 0.061 | 6.768 |
| KTINGHESPHKSGQNIQP | 3692 | 253.840 | 0.000 | 0.000 | 0.000 | 0.000 | 0.000 | 14.042 |
| KTEMKHDSPHKSGQNQQT | 3693 | 240.075 | 0.000 | 0.000 | 0.000 | 0.000 | 0.000 | 3.183 |
| KTINGHDSPHKSVQNHLN | 3694 | 196.758 | 0.000 | 0.000 | 0.000 | 0.000 | 0.000 | 14.557 |
| KTINGHDSPHKIGLDQQT | 3695 | 165.627 | 0.000 | 0.000 | 0.000 | 1.942 | 0.000 | 5.469 |
| KTSNASGSPHSKAQHQQT | 3596 | 165.206 | 0.000 | 0.000 | 0.000 | 0.000 | 0.082 | 40.558 |
| KTINGHDSPHKRGPDQQS | 3696 | 160.084 | 0.000 | 0.000 | 0.000 | 0.000 | 0.000 | 2.923 |
| KTINGMGSPHSKTQNQQT | 3842 | 158.728 | 0.000 | 0.000 | 0.000 | 0.000 | 0.638 | 47.809 |
| KTIKGHDSPHKSGESQQT | 3697 | 142.264 | 0.000 | 0.000 | 0.000 | 0.000 | 0.218 | 4.176 |
| KTEGWHDSPHKSGQNQQT | 3698 | 142.064 | 0.000 | 0.000 | 0.000 | 0.000 | 0.264 | 11.785 |

TABLE 16-continued

NGS fold-enrichment of TTM-001 and TTM-002 matured AAV capsid variants in the brain of NHPs

| Sequence | SEQ ID NO: | Fold Enrichment relative to AAV9 | | | | | |
|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KTINGHDSPHKHGQNHQT | 3699 | 141.405 | 0.191 | 0.000 | 0.000 | 0.000 | 0.000 | 10.214 |
| KTEQLHDSPHKSGQNQQT | 3700 | 138.345 | 0.000 | 0.000 | 0.000 | 0.000 | 0.000 | 12.606 |
| KTVNGTGSPHSKAQNQLT | 3843 | 137.639 | 0.000 | 0.000 | 0.000 | 0.000 | 0.277 | 48.950 |
| KTIIGHDSPHKSGQYQHT | 3701 | 131.825 | 0.000 | 0.000 | 0.000 | 0.000 | 0.211 | 5.762 |
| KTSNGHDSPHKSVQNKQT | 3702 | 130.640 | 0.000 | 0.000 | 0.000 | 0.172 | 0.039 | 11.850 |
| KIVNGQVSPHKSGQNQQT | 3703 | 129.649 | 0.000 | 0.000 | 0.000 | 0.000 | 0.031 | 16.942 |
| KTVNGHDSPHKSGQRQLT | 3704 | 129.641 | 0.000 | 0.000 | 0.000 | 0.000 | 0.487 | 20.145 |
| KTVNGHDSPHKIGQNQLT | 3705 | 128.582 | 0.000 | 0.000 | 0.499 | 0.027 | 0.199 | 20.957 |
| KTINGHDSPHKSGQIIVT | 3706 | 125.245 | 0.000 | 0.000 | 0.151 | 0.000 | 0.379 | 6.808 |
| KTEKIHDSPHKSGQNQQT | 3707 | 125.178 | 0.000 | 0.000 | 0.000 | 0.000 | 0.000 | 17.604 |
| KTENAHDSPHKSGQNQQT | 3708 | 124.477 | 0.000 | 0.000 | 0.000 | 0.000 | 0.062 | 15.805 |
| KIGNGHESPHKSGQNQQT | 3709 | 123.324 | 0.000 | 0.000 | 0.000 | 0.000 | 0.000 | 11.198 |
| KEVMGHDSPHKSGQNQQT | 3710 | 121.107 | 0.000 | 0.000 | 0.000 | 0.000 | 0.000 | 17.191 |
| KTEVKHDSPHKSGQNQQT | 3711 | 119.733 | 0.000 | 0.000 | 0.000 | 0.000 | 0.000 | 5.550 |
| KTINGYDSPHKSGQKQST | 3712 | 119.615 | 0.000 | 0.000 | 0.000 | 0.000 | 0.000 | 7.970 |
| KTIHGNGSPHSKAQNQET | 3844 | 117.388 | 0.000 | 0.000 | 0.000 | 0.000 | 0.000 | 38.874 |
| KYQVGHDSPHKSGQNQQT | 3713 | 112.797 | 0.000 | 0.000 | 0.000 | 0.000 | 0.542 | 9.335 |
| KTEAMHDSPHKSGQNQQT | 3714 | 111.765 | 0.000 | 0.000 | 0.000 | 0.000 | 0.000 | 16.142 |
| KTIKGDDSPHKSVQNQQT | 3715 | 109.397 | 0.000 | 0.000 | 0.000 | 0.000 | 0.000 | 19.125 |
| KTINGHDSPHKSVQSHQT | 3716 | 109.375 | 0.107 | 0.000 | 0.319 | 0.000 | 0.547 | 12.617 |
| KTINGHDSPHKSGQFVVT | 3717 | 108.725 | 0.000 | 0.000 | 0.000 | 0.124 | 0.406 | 10.179 |
| KTVNGHDSPHKSRQNLQT | 3718 | 107.496 | 0.205 | 0.000 | 0.000 | 1.934 | 0.062 | 8.616 |
| KATNGHNSPHKSGQNQET | 3719 | 106.806 | 0.000 | 0.000 | 0.000 | 0.000 | 0.000 | 10.566 |
| KAINGHDSPHKSAQNQQI | 3720 | 106.539 | 0.000 | 0.000 | 0.000 | 0.000 | 0.113 | 21.786 |
| KTEHGHDSPHKSGQNQQT | 3721 | 106.486 | 0.000 | 0.000 | 0.000 | 0.000 | 0.006 | 14.956 |
| KTVENHDSPHKSGQNQQT | 3722 | 106.468 | 0.000 | 0.000 | 0.000 | 0.000 | 0.156 | 9.246 |
| KTIYGHDSPHKSGQSQPT | 3723 | 106.431 | 0.000 | 0.000 | 0.000 | 0.155 | 0.137 | 6.562 |
| KTISGHESPHKSGQNEQT | 3724 | 105.740 | 0.000 | 0.000 | 0.000 | 0.378 | 1.384 | 9.156 |
| KAIIGHDSPHKSAQNQQT | 3725 | 105.292 | 0.000 | 0.000 | 0.000 | 0.000 | 0.553 | 16.793 |
| KAIDGHDSPHKSGQNQLT | 3726 | 104.701 | 0.331 | 0.000 | 0.000 | 0.201 | 0.638 | 16.109 |
| KTIMGHDSPHKSVQNQQT | 3727 | 104.683 | 0.000 | 0.000 | 0.000 | 0.000 | 0.000 | 8.029 |
| KEVGGHDSPHKSGQNQQT | 3728 | 103.896 | 0.000 | 0.000 | 0.000 | 0.000 | 0.000 | 16.899 |
| KTINGHDSPHKSAQNLLT | 3729 | 103.332 | 0.000 | 0.000 | 0.256 | 0.194 | 0.000 | 15.722 |
| KTEFTHDSPHKSGQNQQT | 3730 | 102.052 | 0.062 | 0.000 | 0.000 | 0.439 | 0.047 | 12.527 |
| KTINASGSPHSKAINQQT | 3597 | 101.122 | 0.233 | 0.000 | 0.000 | 0.000 | 0.145 | 47.196 |

TABLE 16-continued

NGS fold-enrichment of TTM-001 and TTM-002 matured AAV capsid variants in the brain of NHPs

| | | Fold Enrichment relative to AAV9 | | | | | | |
|---|---|---|---|---|---|---|---|---|
| Sequence | SEQ ID NO: | Brain (NHP) | DRG (NHP) | Heart (NHP) | Muscle (NHP) | Liver RNA (NHP) | Liver DNA (NHP) | Brain (Mouse) |
| KAINGNGSPHKRGQNQQT | 3845 | 100.925 | 0.000 | 0.000 | 0.000 | 0.000 | 0.159 | 10.011 |
| KSEMGHDSPHKSGQNQQT | 3731 | 100.539 | 0.000 | 0.000 | 0.000 | 0.000 | 0.000 | 18.356 |
| KAQQGHDSPHKSGQNQQT | 3732 | 100.395 | 0.000 | 0.000 | 0.000 | 0.000 | 0.057 | 3.954 |
| KTEVMHDSPHKSGQNQQT | 3733 | 99.473 | 0.000 | 0.000 | 0.000 | 0.000 | 0.000 | 12.400 |
| KAINGHDSPHKSGQSLQT | 3734 | 99.310 | 0.058 | 0.000 | 1.439 | 0.254 | 0.056 | 17.323 |
| KTINGSGSPHSKAPNQQH | 3598 | 99.300 | 0.252 | 0.000 | 0.000 | 0.000 | 0.038 | 39.297 |
| KCGEGHDSPHKSGQNQQT | 3735 | 99.298 | 0.000 | 0.000 | 0.000 | 0.000 | 0.000 | 13.147 |
| KTVNGHDSPHKSAQNHQT | 3736 | 99.257 | 0.000 | 0.000 | 0.078 | 0.000 | 0.027 | 17.639 |
| KTVNGHDSPHKSGQTQLT | 3737 | 98.524 | 0.000 | 0.000 | 0.313 | 0.183 | 0.172 | 14.883 |
| KTNNGHDSPHKSGRNRQT | 3738 | 98.307 | 0.000 | 0.000 | 0.124 | 0.000 | 0.037 | 5.840 |
| KTCNEHDSPHKSGQNQQT | 3739 | 97.092 | 0.000 | 0.000 | 0.000 | 0.000 | 0.000 | 8.364 |
| KTINGHDSPHKYGQNEQT | 3740 | 96.960 | 0.000 | 0.000 | 0.000 | 0.000 | 0.000 | 4.613 |
| KASNRHDSPHKSGHNQQT | 3741 | 96.283 | 0.000 | 0.000 | 0.000 | 0.000 | 0.675 | 8.045 |
| KTINGNGSPHSKAPNLQT | 3846 | 95.963 | 0.000 | 0.000 | 0.000 | 0.000 | 0.247 | 36.341 |
| KTETKHDSPHKSGQNQQT | 3742 | 95.121 | 0.000 | 0.000 | 0.000 | 0.000 | 0.083 | 4.831 |
| KSINGHDSPHKSQQNQQT | 3743 | 94.479 | 0.000 | 0.000 | 0.000 | 0.000 | 1.696 | 9.633 |
| KTIGGHDSPHKSGQNQQI | 3744 | 94.420 | 0.000 | 0.000 | 0.000 | 0.000 | 0.333 | 19.324 |
| KTDPQHDSPHKSGQNQQT | 3745 | 93.931 | 0.000 | 0.000 | 0.000 | 0.906 | 0.019 | 11.749 |
| KTINRHDSPHKIVQNQQT | 3746 | 93.409 | 0.000 | 0.000 | 0.000 | 0.000 | 0.000 | 3.064 |
| KTEQYHDSPHKSGQNQQT | 3747 | 93.065 | 0.000 | 0.000 | 0.000 | 0.000 | 0.047 | 15.190 |
| KTINGHDSPHKSVQSKQT | 3748 | 92.445 | 0.000 | 0.000 | 0.078 | 0.000 | 0.047 | 4.263 |
| KELVGHDSPHKSGQNQQT | 3749 | 92.262 | 0.000 | 0.000 | 0.000 | 0.594 | 0.000 | 14.890 |
| KTENRHDSPHKSGQNQQT | 3750 | 91.675 | 0.000 | 0.000 | 0.000 | 0.000 | 0.000 | 13.282 |
| KELMGHDSPHKSGQNQQT | 3751 | 91.191 | 0.000 | 0.000 | 0.000 | 0.000 | 0.000 | 14.032 |
| KTINGNDSPHKIGHNQQT | 3752 | 91.183 | 0.000 | 0.000 | 0.117 | 0.000 | 0.270 | 11.095 |
| KTIKGGGSPHSKAQDQQT | 3847 | 91.172 | 0.000 | 0.000 | 0.000 | 0.064 | 0.085 | 49.580 |
| KTEGHHDSPHKSGQNQQT | 3753 | 89.922 | 0.000 | 0.000 | 0.000 | 0.000 | 0.000 | 23.929 |
| KTEGYHDSPHKSGQNQQT | 3754 | 89.891 | 0.000 | 0.000 | 0.000 | 0.000 | 0.000 | 15.116 |
| KTVNGHDSPHKSGQTQQI | 3755 | 89.801 | 0.000 | 0.000 | 0.657 | 0.000 | 0.542 | 11.543 |
| KTINGQDSPHKSGQNPLT | 3756 | 89.726 | 0.000 | 0.000 | 0.000 | 0.363 | 0.000 | 15.561 |
| KTVNASGSPHSKAQNHQT | 3599 | 89.467 | 0.091 | 0.000 | 0.000 | 0.045 | 0.252 | 39.024 |
| KTINGHDSPHKSGRDQKT | 3757 | 88.871 | 0.000 | 0.000 | 0.000 | 0.350 | 0.181 | 12.117 |
| KTINGHDSPHKSVHNQQN | 3758 | 88.715 | 0.089 | 0.000 | 0.081 | 0.000 | 0.143 | 10.787 |
| KTINGHDSPHKSGQWKRT | 3759 | 88.633 | 0.000 | 0.000 | 0.000 | 0.202 | 0.094 | 5.186 |
| KTIDGSGSPHSKAENRQT | 3600 | 87.993 | 0.092 | 0.000 | 0.000 | 0.139 | 0.054 | 40.629 |
| KNEIGHDSPHKSGQNQQT | 3760 | 87.758 | 0.000 | 0.000 | 0.000 | 0.000 | 0.055 | 14.110 |

TABLE 16-continued

NGS fold-enrichment of TTM-001 and TTM-002 matured AAV capsid variants in the brain of NHPs

| | | Fold Enrichment relative to AAV9 | | | | | | |
|---|---|---|---|---|---|---|---|---|
| Sequence | SEQ ID NO: | Brain (NHP) | DRG (NHP) | Heart (NHP) | Muscle (NHP) | Liver RNA (NHP) | Liver DNA (NHP) | Brain (Mouse) |
| KAINGHDSPHKSGQSQQI | 3761 | 87.585 | 0.000 | 0.000 | 5.310 | 0.000 | 0.000 | 12.864 |
| KIINGHDSPHKSRQAQQT | 3762 | 86.966 | 0.000 | 0.000 | 0.000 | 0.000 | 0.000 | 9.193 |
| KTPNGHDSPHKSGQNQQI | 3763 | 86.683 | 0.000 | 0.000 | 0.000 | 0.000 | 0.109 | 21.278 |
| KITNGHDSPHKSGQTQQT | 3764 | 86.443 | 0.000 | 0.000 | 0.000 | 0.192 | 0.190 | 17.479 |
| KTINGHDSPHKSVQNHQI | 3765 | 86.395 | 0.000 | 0.000 | 0.000 | 0.000 | 0.000 | 9.148 |
| KTINGHDSPHKSKQNQQA | 3766 | 86.265 | 0.000 | 0.000 | 0.000 | 0.123 | 0.041 | 5.768 |
| KTINGHDSPHKSAQNQLN | 3767 | 86.153 | 0.000 | 0.000 | 0.000 | 0.050 | 0.019 | 15.587 |
| KTDITHDSPHKSGQNQQT | 3768 | 85.876 | 0.000 | 0.000 | 0.000 | 0.000 | 0.013 | 9.076 |
| KTVNGHDSPHKSGQTQPT | 3769 | 85.680 | 0.000 | 0.000 | 1.301 | 1.064 | 0.000 | 8.067 |
| KTEKFHDSPHKSGQNQQT | 3770 | 85.358 | 0.000 | 0.000 | 0.000 | 0.000 | 0.026 | 7.229 |
| KTDQGHDSPHKSGQNQQT | 3771 | 85.267 | 0.000 | 0.000 | 0.000 | 0.000 | 0.000 | 16.042 |
| KTINGHDSPHKLWINQQT | 3772 | 85.132 | 0.000 | 0.000 | 1.154 | 0.000 | 0.017 | 12.704 |
| KGINGPDSPHKSGQNQQT | 3773 | 85.080 | 0.000 | 0.000 | 0.084 | 0.000 | 0.054 | 13.750 |
| KSEIGHDSPHKSGQNQQT | 3774 | 84.789 | 0.000 | 0.000 | 0.000 | 0.000 | 0.013 | 15.955 |
| KTINGHDSPHKSVQKQLT | 3775 | 84.351 | 0.000 | 0.000 | 0.000 | 0.038 | 0.103 | 11.890 |
| KTINGHPSPHWKGQNQQT | 3848 | 84.153 | 0.000 | 0.000 | 0.000 | 0.000 | 0.058 | 3.280 |
| KTVNGHDSPHKSGRNQLA | 3776 | 83.858 | 0.000 | 0.000 | 0.000 | 0.000 | 0.132 | 21.252 |
| KTNNVHDSPHKSGQNQQS | 3777 | 83.697 | 0.000 | 0.000 | 0.000 | 0.176 | 0.000 | 7.117 |
| KTIKGSGSPHSKVQDQQT | 3601 | 83.077 | 0.000 | 0.000 | 0.034 | 0.000 | 0.107 | 21.001 |
| KSEKGHDSPHKSGQNQQT | 3778 | 82.982 | 0.000 | 0.000 | 0.000 | 0.000 | 0.105 | 16.662 |
| KWSAGHDSPHKSGQNQQT | 3779 | 82.949 | 0.000 | 0.000 | 0.000 | 0.000 | 0.211 | 12.499 |
| KELAGHDSPHKSGQNQQT | 3780 | 82.876 | 0.000 | 0.000 | 0.000 | 0.000 | 0.093 | 18.063 |
| KTINGHDSPHKMGRNQQS | 3781 | 82.787 | 0.000 | 0.000 | 0.000 | 0.000 | 0.000 | 6.467 |
| KTDQAHDSPHKSGQNQQT | 3782 | 82.402 | 0.000 | 0.000 | 0.141 | 0.000 | 0.000 | 13.397 |
| KTETQHDSPHKSGQNQQT | 3783 | 82.316 | 0.000 | 0.000 | 0.000 | 0.000 | 0.198 | 10.823 |
| KTEMTHDSPHKSGQNQQT | 3784 | 82.221 | 0.000 | 0.000 | 0.000 | 0.000 | 0.000 | 8.431 |
| KTINGHDSPHKSGISIQT | 3785 | 82.019 | 0.000 | 0.000 | 0.000 | 0.191 | 0.044 | 7.310 |
| KTDAVHDSPHKSGQNQQT | 3786 | 81.968 | 0.000 | 0.000 | 0.000 | 0.297 | 0.107 | 13.596 |
| KTSNGHDSPHKSVQNLQT | 3787 | 81.921 | 0.000 | 0.000 | 0.072 | 0.000 | 0.330 | 11.544 |
| KTEKYHDSPHKSGQNQQT | 3788 | 81.637 | 0.000 | 0.000 | 0.000 | 0.000 | 0.013 | 7.580 |
| KQTQGHDSPHKSGQNQQT | 3789 | 81.581 | 0.000 | 0.000 | 0.000 | 0.000 | 0.133 | 15.225 |
| KTINGHDSPHKMAHNQQT | 3790 | 81.329 | 0.000 | 0.000 | 0.000 | 0.000 | 0.094 | 15.949 |
| KAINGSGSPHSKAQTQQA | 3602 | 81.207 | 0.000 | 0.000 | 0.000 | 0.000 | 0.016 | 40.435 |
| KTINGHDSPHKHGQNQQN | 3791 | 81.065 | 0.000 | 0.000 | 0.000 | 0.000 | 0.000 | 4.110 |
| KGADGHDSPHKSGQNQQT | 3792 | 80.981 | 0.000 | 0.000 | 0.000 | 0.000 | 0.074 | 11.423 |

TABLE 16-continued

NGS fold-enrichment of TTM-001 and TTM-002 matured AAV capsid variants in the brain of NHPs

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KVGEGHDSPHKSGQNQQT | 3793 | 80.775 | 0.084 | 0.000 | 0.000 | 0.000 | 0.019 | 16.378 |
| KANEGHDSPHKSGQNQQT | 3794 | 80.470 | 0.000 | 0.000 | 0.000 | 0.000 | 0.000 | 12.818 |
| KTDTMHDSPHKSGQNQQT | 3795 | 80.364 | 0.000 | 0.000 | 0.000 | 0.000 | 0.000 | 13.166 |
| KTEAKSGSPHSKAQNQQT | 3603 | 80.088 | 0.192 | 0.000 | 0.000 | 0.000 | 0.613 | 47.130 |
| KTINGHDSPHKSVQSQQS | 3796 | 80.000 | 0.000 | 0.000 | 0.000 | 1.055 | 0.082 | 17.620 |
| KTIPGSGSPHSKAQNLQT | 3604 | 79.973 | 0.871 | 0.000 | 0.000 | 0.000 | 0.000 | 32.693 |
| KTCIAHDSPHKSGQNQQT | 3797 | 79.857 | 0.000 | 0.000 | 0.066 | 0.000 | 0.093 | 1.930 |
| KTINGHDSPHKSGQTVCT | 3798 | 79.730 | 0.000 | 0.000 | 0.000 | 0.050 | 0.030 | 7.873 |
| KELRGHDSPHKSGQNQQT | 3799 | 79.596 | 0.000 | 0.000 | 0.000 | 0.000 | 0.006 | 22.001 |
| KCQIGHDSPHKSGQNQQT | 3800 | 79.359 | 0.000 | 0.000 | 0.000 | 0.000 | 0.000 | 2.614 |
| KGVMGHDSPHKSGQNQQT | 3801 | 79.170 | 0.000 | 0.000 | 0.000 | 0.138 | 0.086 | 17.287 |
| KACDGHDSPHKSGQNQQT | 3802 | 78.648 | 0.000 | 0.000 | 0.000 | 0.000 | 0.128 | 17.767 |
| KTINGQDSPHKSGQYQQI | 3803 | 78.585 | 0.000 | 0.000 | 0.000 | 0.286 | 0.672 | 5.664 |
| KTINGHDSPHKSGQQIMT | 3804 | 78.534 | 0.000 | 0.000 | 0.000 | 0.000 | 0.058 | 7.067 |
| KTINGHDSPHKSRQNEQS | 3805 | 78.534 | 0.000 | 0.000 | 0.000 | 0.112 | 0.188 | 13.388 |
| KASNGHDSPHKSGLNHQT | 3806 | 78.451 | 0.000 | 0.000 | 0.000 | 0.000 | 0.000 | 17.975 |
| KTVNGHDSPHKSGQSQPT | 3807 | 78.309 | 0.000 | 0.000 | 0.000 | 0.000 | 0.231 | 10.627 |
| KNELGHDSPHKSGQNQQT | 3808 | 78.135 | 0.000 | 0.000 | 0.000 | 0.000 | 0.182 | 17.457 |
| KTETFHDSPHKSGQNQQT | 3809 | 78.070 | 0.000 | 0.000 | 0.000 | 0.782 | 0.007 | 4.693 |
| KAAEGHDSPHKSGQNQQT | 3810 | 77.793 | 0.000 | 0.000 | 0.000 | 0.000 | 0.060 | 13.552 |
| KGQNGHDSPHKSGQNQQT | 3811 | 77.770 | 0.000 | 0.000 | 0.000 | 0.107 | 0.056 | 13.618 |
| KNEFGHDSPHKSGQNQQT | 3812 | 77.740 | 0.000 | 0.000 | 0.000 | 0.000 | 0.029 | 16.318 |
| KTSIGYDSPHKSGQNQQT | 3813 | 77.730 | 0.000 | 0.000 | 0.000 | 0.057 | 0.178 | 4.831 |
| KTDNGHDSPHKSGQNLQT | 3814 | 77.565 | 0.504 | 0.000 | 0.000 | 0.000 | 0.000 | 16.184 |
| KTEGQHDSPHKSGQNQQT | 3815 | 77.423 | 0.000 | 0.000 | 0.000 | 0.000 | 0.748 | 20.310 |
| KTITGHDSPHKSRQDQQT | 3816 | 77.127 | 0.000 | 0.000 | 0.000 | 0.000 | 0.000 | 6.250 |
| KAEHGHDSPHKSGQNQQT | 3817 | 77.026 | 0.000 | 0.000 | 0.000 | 0.000 | 0.017 | 20.937 |
| KTINGDDSPHKSGQKQLT | 3818 | 76.968 | 0.000 | 0.000 | 0.000 | 0.163 | 0.014 | 15.820 |
| KCDQGHDSPHKSGQNQQT | 3819 | 76.887 | 0.000 | 0.000 | 0.000 | 0.193 | 0.013 | 27.317 |
| KEILGHDSPHKSGQNQQT | 3820 | 76.770 | 0.000 | 0.000 | 0.000 | 0.804 | 0.009 | 10.771 |
| KTIHGSGSPHSKAQNQAT | 3605 | 76.765 | 0.000 | 0.000 | 0.000 | 0.000 | 0.215 | 43.969 |
| KTERNHDSPHKSGQNQQT | 3821 | 76.751 | 0.000 | 0.000 | 0.000 | 0.000 | 0.000 | 14.979 |
| KAINGDDSPHKSGHNQQT | 3822 | 76.578 | 0.000 | 0.000 | 0.000 | 0.032 | 0.059 | 17.755 |
| KTSNGHNSPHKSGQNQET | 3823 | 76.515 | 0.000 | 0.000 | 0.000 | 0.000 | 0.000 | 4.764 |
| KTINGHDSPHKSGQMIHT | 3824 | 76.364 | 0.000 | 0.000 | 0.000 | 0.000 | 0.000 | 9.486 |
| KNAIGHDSPHKSGQNQQT | 3825 | 76.289 | 0.000 | 0.000 | 0.000 | 0.009 | 0.072 | 15.178 |

TABLE 16-continued

NGS fold-enrichment of TTM-001 and TTM-002 matured AAV capsid variants in the brain of NHPs

| Sequence | SEQ ID NO: | Fold Enrichment relative to AAV9 | | | | | | |
|---|---|---|---|---|---|---|---|---|
| | | Brain (NHP) | DRG (NHP) | Heart (NHP) | Muscle (NHP) | Liver RNA (NHP) | Liver DNA (NHP) | Brain (Mouse) |
| KTDKFHDSPHKSGQNQQT | 3826 | 76.204 | 0.000 | 0.000 | 0.000 | 0.000 | 0.000 | 7.096 |
| KTEGFHDSPHKSGQNQQT | 3827 | 76.191 | 0.000 | 0.000 | 0.000 | 0.000 | 0.080 | 13.163 |
| KVINGHDSPHKSGRNHQS | 3828 | 75.961 | 0.000 | 0.000 | 0.000 | 0.000 | 0.000 | 13.568 |
| KTITGHDSPHKSVQNRQT | 3829 | 75.940 | 0.000 | 0.000 | 0.000 | 0.621 | 0.000 | 4.310 |
| KTPDMHDSPHKSGQNQQT | 3830 | 75.871 | 0.659 | 0.000 | 0.000 | 0.000 | 0.048 | 11.277 |
| KTINGHDSPHKSGQKMNT | 3831 | 75.820 | 0.000 | 0.000 | 0.000 | 0.000 | 0.167 | 6.373 |
| KTELQHDSPHKSGQNQQT | 3832 | 75.814 | 0.000 | 0.000 | 0.000 | 0.105 | 0.000 | 11.798 |
| KTIHGHDSPHKSGQSQQN | 3833 | 75.777 | 0.000 | 0.000 | 0.059 | 0.000 | 0.166 | 7.426 |
| KTEIGHDSPHKSGQNQQT | 3834 | 75.525 | 0.000 | 0.000 | 0.016 | 0.012 | 0.000 | 9.593 |
| KTINGHDSPHKSGQYQHA | 3835 | 75.308 | 0.000 | 0.000 | 0.000 | 0.000 | 0.017 | 17.081 |
| KTELYHDSPHKSGQNQQT | 3836 | 75.235 | 0.000 | 0.000 | 0.000 | 0.000 | 0.042 | 10.354 |

Table 17 provides the sequences of 216 matured capsid variants having a CV of less than 1 for the liver RNA samples isolated and a 10-fold or greater increase in expression relative to AAV9 in the liver of NHPs. These matured variants showed preferential transduction of the liver over other tissues as shown by a low value for fold-enrichment relative to AAV9 in the other tissues investigated including the brain, DRG, heart and muscle. As such, Table 17 provides TTM-001 and TTM-002 matured AAV capsid variants with liver-specific tropism. Across the peptides within the matured capsid variants in Table 17, approximately 175 of them comprised the sequence GSGSPH (SEQ ID NO: 4695) and further comprised additional modifications in the C-terminal region of the sequence.

TABLE 17

NGS fold-enrichment of TTM-001 and TTM-002 matured AAV capsid variants in the liver of NHPs

| Sequence | SEQ ID NO: | Fold Enrichment relative to AAV9 Liver RNA (NHP) | Liver DNA (NHP) | Brain (NHP) | DRG (NHP) | Heart (NHP) | Muscle (NHP) |
|---|---|---|---|---|---|---|---|
| KTQRKSGSPHSKAQNQQT | 4011 | 119.659 | 1.439 | 0.000 | 0.000 | 0.000 | 0.000 |
| KTINGSGSPHSKAQARKT | 4681 | 96.557 | 3.644 | 0.000 | 0.000 | 0.000 | 0.000 |
| KYIVGSGSPHSKAQNQQT | 4682 | 94.721 | 4.480 | 0.000 | 0.000 | 0.000 | 0.000 |
| KTINGSGSPHSMYMNQQT | 4683 | 81.106 | 5.840 | 0.000 | 0.000 | 0.000 | 0.000 |
| KTINGSGSPHSKAFYRQT | 4684 | 77.541 | 3.577 | 0.000 | 0.000 | 0.000 | 0.000 |
| KTINGSGSPHSKLKRQQT | 4685 | 76.103 | 6.884 | 0.000 | 0.000 | 0.000 | 0.000 |
| KTINGSGSPHSKRHRQQT | 4686 | 73.225 | 4.648 | 0.000 | 0.000 | 0.000 | 0.000 |
| KTINGSGSPHSKAQKCIT | 4687 | 69.547 | 1.887 | 0.000 | 0.000 | 0.000 | 0.000 |
| KTINGSGSPHSKWRLQQT | 4688 | 68.083 | 2.037 | 0.000 | 0.000 | 0.000 | 0.000 |
| KTINGSGSPHSRCRNQQT | 4689 | 64.416 | 5.150 | 0.000 | 0.000 | 0.000 | 0.000 |
| KTINGSGSPHSFTCNQQT | 4690 | 63.936 | 2.155 | 0.000 | 0.000 | 0.000 | 271.289 |
| KTINGSGSPHSKFFIQQT | 4691 | 63.255 | 6.916 | 0.000 | 0.000 | 0.000 | 0.000 |
| KTINGSYSPHCLAQNQQT | 4012 | 62.942 | 0.309 | 0.000 | 0.000 | 0.000 | 0.000 |

TABLE 17-continued NGS fold-enrichment of TTM-001 and TTM-002 matured AAV capsid variants in the liver of NHPs

| Sequence | SEQ ID NO: | Fold Enrichment relative to AAV9 | | | | | |
|---|---|---|---|---|---|---|---|
| | | Liver RNA (NHP) | Liver DNA (NHP) | Brain (NHP) | DRG (NHP) | Heart (NHP) | Muscle (NHP) |
| KTINGSGSPHSKAQYSRT | 4692 | 60.119 | 0.956 | 0.000 | 0.000 | 0.000 | 0.000 |
| KTINGSGSPHIVWQNQQT | 3849 | 58.021 | 6.056 | 0.000 | 0.000 | 0.000 | 0.000 |
| KTINGSGSPHSKYFMQQT | 3850 | 57.350 | 2.993 | 0.000 | 0.000 | 0.000 | 0.000 |
| KTINGSGSPHSKARQRQT | 3851 | 56.775 | 2.205 | 0.000 | 0.000 | 0.000 | 0.000 |
| KTINGSGSPHSCHQNQQT | 3852 | 56.242 | 8.562 | 0.000 | 0.000 | 0.000 | 0.000 |
| KTINGSGSPHFPWQNQQT | 3853 | 53.587 | 1.731 | 0.000 | 0.000 | 0.000 | 0.000 |
| KTINGSGSPHSKIRRQQT | 3854 | 53.528 | 1.388 | 0.000 | 0.000 | 0.000 | 0.000 |
| KTINGSGSPHVYYQNQQT | 3855 | 53.294 | 2.173 | 0.944 | 0.000 | 0.246 | 5.268 |
| KTINGSGSPHSLYWNQQT | 3856 | 53.262 | 0.000 | 0.000 | 0.000 | 0.000 | 0.000 |
| KTINGSGSPHSKPKRQQT | 3857 | 52.881 | 2.832 | 0.000 | 0.000 | 0.000 | 0.000 |
| KPRWGSGSPHSKAQNQQT | 3858 | 51.637 | 0.386 | 0.000 | 0.000 | 375.537 | 0.000 |
| KTINGSGSPHSKAFSWQT | 3859 | 51.304 | 1.805 | 0.000 | 0.000 | 0.000 | 0.000 |
| KTINGSGSPHSRFWNQQT | 3860 | 51.225 | 6.955 | 0.000 | 0.000 | 0.000 | 0.000 |
| KTINGSGSPHSKAQCLKT | 3861 | 49.565 | 1.453 | 0.000 | 0.000 | 0.000 | 0.000 |
| KTINGSGSPHSRMRNQQT | 3862 | 48.902 | 2.816 | 0.000 | 0.000 | 0.000 | 0.000 |
| KTINGSGSPHSVKKNQQT | 3863 | 48.475 | 3.908 | 0.000 | 0.000 | 0.000 | 0.000 |
| KTINGSGSPHSWAPNQQT | 3864 | 47.897 | 1.789 | 0.000 | 0.000 | 0.000 | 0.000 |
| KTINGSGSPHSLWKNQQT | 3865 | 45.796 | 4.010 | 0.000 | 0.000 | 0.000 | 0.000 |
| KTINGSGSPHSKARWQQT | 3866 | 45.017 | 2.377 | 0.000 | 0.000 | 0.000 | 0.000 |
| KTINGSGSPHSFRPNQQT | 3867 | 44.801 | 9.191 | 0.000 | 0.000 | 0.000 | 0.000 |
| KTINGSGSPHSKKVFQQT | 3868 | 43.747 | 4.480 | 0.000 | 0.000 | 0.000 | 0.000 |
| KTINGSLSPHFWAQNQQT | 4013 | 43.190 | 2.041 | 0.000 | 0.000 | 0.000 | 0.000 |
| KTINGSGSPHSYAFNQQT | 3869 | 43.037 | 1.742 | 0.000 | 0.000 | 0.000 | 0.000 |
| KTINHRISPHSKAQNQQT | 4014 | 42.998 | 1.876 | 0.000 | 0.000 | 0.000 | 0.000 |
| KTINGSGSPHSKACSRQT | 3870 | 42.696 | 2.468 | 0.000 | 0.000 | 0.000 | 0.000 |
| KTRRPSGSPHSKAQNQQT | 4015 | 42.374 | 2.384 | 0.000 | 0.000 | 0.000 | 0.000 |
| KYSAGSGSPHSKAQNQQT | 3871 | 41.310 | 1.824 | 0.000 | 0.000 | 0.000 | 0.000 |
| KTINGAYSPHRKAQNQQT | 4016 | 40.969 | 1.283 | 0.000 | 0.000 | 0.000 | 0.000 |
| KTINGSGSPHSKRLWQQT | 3872 | 40.932 | 4.801 | 0.000 | 0.000 | 0.000 | 0.000 |
| KTINGSGSPHSCSRNQQT | 3873 | 40.372 | 4.293 | 0.000 | 0.000 | 0.000 | 0.000 |
| KTINGSGSPHSRCPNQQT | 3874 | 39.529 | 4.890 | 0.000 | 0.000 | 0.000 | 0.000 |
| KTINGSGSPHSGACNQQT | 3875 | 39.163 | 3.215 | 0.000 | 0.000 | 0.000 | 4733.916 |
| KYYTGSGSPHSKAQNQQT | 3876 | 38.777 | 1.199 | 0.000 | 0.000 | 0.000 | 0.000 |
| KTINGSGSPHSKFRQQT | 3877 | 38.665 | 3.260 | 0.000 | 0.000 | 0.000 | 0.000 |
| KTINGSGSPHSFPFNQQT | 3878 | 38.584 | 4.693 | 0.000 | 0.000 | 0.000 | 0.000 |

TABLE 17-continued

NGS fold-enrichment of TTM-001 and TTM-002 matured AAV capsid variants in the liver of NHPs

| Sequence | SEQ ID NO: | Fold Enrichment relative to AAV9 ||||||
| | | Liver RNA (NHP) | Liver DNA (NHP) | Brain (NHP) | DRG (NHP) | Heart (NHP) | Muscle (NHP) |
|---|---|---|---|---|---|---|---|
| KTINGSGSPHSFFGNQQT | 3879 | 38.088 | 6.101 | 0.000 | 0.000 | 0.000 | 0.000 |
| KTINGRRSPHGKAQNQQT | 4017 | 37.728 | 3.259 | 0.000 | 0.000 | 0.000 | 0.000 |
| KTINGSGSPHSMCQNQQT | 3880 | 37.209 | 1.348 | 0.000 | 0.000 | 0.000 | 0.000 |
| KTINGSGSPHSKLFWQQT | 3881 | 37.022 | 4.178 | 0.000 | 0.000 | 0.000 | 0.000 |
| KTINGSGSPHSKTRKQQT | 3882 | 36.010 | 2.858 | 0.000 | 0.000 | 0.000 | 0.000 |
| KTINGRTSPHRKAQNQQT | 4018 | 35.792 | 5.682 | 0.000 | 0.000 | 0.000 | 0.000 |
| KTINGSGSPHSGKRNQQT | 3883 | 35.120 | 5.396 | 0.000 | 0.000 | 0.000 | 0.000 |
| KTINGSGSPHSKAQNFKR | 3884 | 32.291 | 0.964 | 0.000 | 0.000 | 0.000 | 0.000 |
| KTINGSGSPHFYRQNQQT | 3885 | 31.724 | 9.342 | 0.000 | 0.000 | 0.000 | 0.000 |
| KTINGSRSPHAWAQNQQT | 4019 | 31.146 | 6.838 | 0.000 | 0.000 | 0.000 | 0.000 |
| KTINGSGSPHCRVQNQQT | 3886 | 31.043 | 1.203 | 0.000 | 0.000 | 0.000 | 0.000 |
| KTINGSGSPHYGIQNQQT | 3887 | 30.908 | 1.076 | 0.000 | 0.000 | 0.000 | 0.000 |
| KTINKCLSPHSKAQNQQT | 4020 | 30.667 | 5.097 | 0.000 | 0.000 | 0.000 | 0.000 |
| KTINGSGSPHSKAQRFKT | 3888 | 30.363 | 0.139 | 0.000 | 0.000 | 0.000 | 0.000 |
| KTINGSGSPHVNCQNQQT | 3889 | 30.010 | 6.122 | 0.000 | 0.000 | 0.000 | 0.000 |
| KTINGSGSPHSKPFRQQT | 3890 | 29.842 | 8.700 | 0.000 | 0.000 | 0.000 | 0.000 |
| KTINGSGSPHSLAWNQQT | 3891 | 29.015 | 4.746 | 0.000 | 0.000 | 0.000 | 0.000 |
| KTINGSGSPHSKRSYQQT | 3892 | 28.973 | 2.116 | 0.000 | 0.000 | 0.000 | 0.000 |
| KTINGSSSPHRCAQNQQT | 4021 | 28.887 | 1.829 | 0.000 | 0.000 | 0.000 | 0.000 |
| KTINGSGSPHWSYQNQQT | 3893 | 28.607 | 3.751 | 0.000 | 0.000 | 0.000 | 0.000 |
| KTINCRTSPHSKAQNQQT | 4022 | 28.301 | 1.117 | 0.000 | 0.000 | 0.000 | 0.000 |
| KTINGSGSPHRWLQNQQT | 3894 | 28.147 | 6.882 | 0.000 | 0.000 | 0.000 | 0.000 |
| KTIFDCGSPHSKAQNQQT | 4023 | 27.844 | 1.602 | 0.000 | 0.000 | 0.000 | 0.000 |
| KTINGSGSPHPSCQNQQT | 3895 | 27.796 | 2.790 | 0.000 | 0.000 | 0.000 | 0.000 |
| KTINGSGSPHSSWLNQQT | 3896 | 27.318 | 3.271 | 0.000 | 0.000 | 0.000 | 0.000 |
| KTINSPRSPHSKAQNQQT | 4024 | 27.240 | 1.554 | 0.000 | 0.000 | 0.000 | 0.000 |
| KPRFGSGSPHSKAQNQQT | 3897 | 27.203 | 0.657 | 0.000 | 0.000 | 0.000 | 0.000 |
| KWLTGSGSPHSKAQNQQT | 3898 | 26.975 | 2.388 | 0.364 | 0.000 | 0.000 | 2578.486 |
| KTINGSGSPHSKRRAQQT | 3899 | 26.523 | 5.906 | 0.000 | 0.000 | 0.000 | 0.000 |
| KTINGSGSPHSKAQTCRT | 3900 | 26.472 | 6.369 | 0.000 | 0.000 | 0.000 | 0.000 |
| KTINGLDSPHRSRQNQQT | 4025 | 26.403 | 0.321 | 0.000 | 0.000 | 0.000 | 0.000 |
| KTINGSGSPHSKGCTQQT | 3901 | 26.068 | 0.529 | 0.000 | 0.000 | 0.000 | 0.000 |
| KTRTRSGSPHSKAQNQQT | 4026 | 25.852 | 6.894 | 0.000 | 0.000 | 0.000 | 0.000 |
| KTINGSGSPHVPWQNQQT | 3902 | 25.294 | 3.435 | 0.000 | 0.000 | 0.000 | 0.000 |
| KTINGSGSPHSKRYTQQT | 3903 | 25.267 | 9.412 | 0.000 | 0.000 | 0.000 | 0.000 |
| KTINGSISPHCPAQNQQT | 4027 | 24.932 | 0.556 | 0.000 | 0.000 | 0.000 | 0.000 |

TABLE 17-continued

NGS fold-enrichment of TTM-001 and TTM-002 matured AAV capsid variants in the liver of NHPs

| Sequence | SEQ ID NO: | Fold Enrichment relative to AAV9 | | | | | |
|---|---|---|---|---|---|---|---|
| | | Liver RNA (NHP) | Liver DNA (NHP) | Brain (NHP) | DRG (NHP) | Heart (NHP) | Muscle (NHP) |
| KTINGSGSPHSGCQNQQT | 3904 | 24.818 | 1.981 | 0.000 | 0.000 | 0.000 | 0.000 |
| KTINGSGSPHSFTPNQQT | 3905 | 24.227 | 1.036 | 0.000 | 0.000 | 0.000 | 0.000 |
| KTINGSGSPHSTTCNQQT | 3906 | 23.771 | 3.315 | 0.000 | 0.000 | 0.000 | 0.000 |
| KTINGSGSPHSKARMYQT | 3907 | 23.424 | 0.313 | 0.000 | 0.000 | 0.000 | 0.000 |
| KTINGLVSPHRKAQNQQT | 4028 | 23.417 | 2.739 | 0.000 | 0.000 | 0.000 | 0.000 |
| KTINGSGSPHPKRQNQQT | 3908 | 23.055 | 2.355 | 0.000 | 0.000 | 0.000 | 0.000 |
| KTINGSGSPHSKCFLQQT | 3909 | 22.987 | 1.434 | 0.000 | 0.000 | 0.000 | 0.000 |
| KTINGSGSPHWVPQNQQT | 3910 | 22.907 | 3.219 | 0.000 | 0.000 | 0.000 | 0.000 |
| KTINGSGSPHSFWSNQQT | 3911 | 22.857 | 1.345 | 0.000 | 0.000 | 0.000 | 0.000 |
| KRSYGSGSPHSKAQNQQT | 3912 | 22.474 | 2.841 | 0.000 | 0.000 | 0.000 | 0.000 |
| KYVFGSGSPHSKAQNQQT | 3913 | 22.232 | 2.346 | 0.000 | 0.000 | 0.000 | 0.000 |
| KTINGSGSPHSKFKNQQT | 3914 | 21.951 | 1.074 | 0.000 | 0.000 | 0.000 | 0.000 |
| KTINGSGSPHRIKQNQQT | 3915 | 21.720 | 3.064 | 0.000 | 0.000 | 0.000 | 0.000 |
| KTINGSGSPHSKAPRRQT | 3916 | 21.645 | 3.940 | 0.000 | 0.000 | 0.000 | 0.000 |
| KTINGSGSPHSFRYNQQT | 3917 | 21.097 | 4.148 | 0.000 | 0.000 | 0.000 | 0.000 |
| KTINGSGSPHSKMICQQT | 3918 | 21.036 | 0.144 | 0.000 | 0.000 | 0.000 | 0.000 |
| KTINGSGSPHLRWQNQQT | 3919 | 21.014 | 9.649 | 0.000 | 0.000 | 0.000 | 0.000 |
| KTINGSGSPHLPTQNQQT | 3920 | 20.704 | 3.127 | 0.000 | 0.000 | 0.000 | 0.000 |
| KTINGSGSPHSKWKSQQT | 3921 | 20.390 | 1.239 | 0.000 | 0.000 | 4.904 | 0.163 |
| KTINALRSPHSKAQNQQT | 4029 | 20.053 | 1.655 | 0.000 | 0.000 | 0.000 | 0.000 |
| KTINGSGSPHSYMRNQQT | 3922 | 20.007 | 2.293 | 0.000 | 0.000 | 0.000 | 0.000 |
| KTINGSGSPHSKAARRQT | 3923 | 19.998 | 6.633 | 0.000 | 0.000 | 0.000 | 0.000 |
| KTINGSGSPHLLCQNQQT | 3924 | 19.796 | 3.484 | 0.673 | 0.000 | 0.000 | 1.309 |
| KTINGSGSPHRCCQNQQT | 3925 | 19.084 | 2.213 | 0.000 | 0.000 | 0.000 | 0.000 |
| KTINGSGSPHLCVQNQQT | 3926 | 19.030 | 1.428 | 0.000 | 0.000 | 0.000 | 0.000 |
| KTINGSGSPHSKLTRQQT | 3927 | 19.004 | 2.712 | 0.000 | 0.000 | 0.000 | 0.000 |
| KTICGRGSPHSKAQNQQT | 4030 | 18.923 | 2.171 | 0.000 | 0.000 | 0.000 | 0.000 |
| KTTRKSGSPHSKAQNQQT | 4031 | 18.849 | 2.617 | 0.000 | 0.000 | 0.000 | 0.000 |
| KTINGSGSPHSKLCTQQT | 3928 | 18.674 | 1.269 | 0.000 | 0.000 | 0.000 | 0.000 |
| KKHLGSGSPHSKAQNQQT | 3929 | 18.521 | 0.658 | 0.000 | 0.000 | 0.000 | 0.000 |
| KTINGSGSPHSKIRGQQT | 3930 | 18.150 | 1.584 | 0.000 | 0.000 | 0.000 | 0.000 |
| KTMQRSGSPHSKAQNQQT | 4032 | 18.020 | 3.159 | 0.000 | 0.000 | 0.000 | 0.000 |
| KTINGSGSPHSYLVNQQT | 3931 | 17.766 | 1.267 | 0.000 | 0.000 | 0.000 | 0.000 |
| KTINGSGSPHQGCQNQQT | 3932 | 17.676 | 1.037 | 0.000 | 0.000 | 0.000 | 0.000 |
| KTINGSGSPHMAFQNQQT | 3933 | 17.644 | 0.542 | 0.000 | 0.000 | 0.000 | 0.000 |

TABLE 17-continued

NGS fold-enrichment of TTM-001 and TTM-002 matured AAV capsid variants in the liver of NHPs

| Sequence | SEQ ID NO: | Fold Enrichment relative to AAV9 | | | | | |
|---|---|---|---|---|---|---|---|
| | | Liver RNA (NHP) | Liver DNA (NHP) | Brain (NHP) | DRG (NHP) | Heart (NHP) | Muscle (NHP) |
| KTINGSGSPHSKACQFQT | 3934 | 17.640 | 8.562 | 0.000 | 0.000 | 0.000 | 9.605 |
| KTINGSGSPHSKWGLQQT | 3935 | 17.543 | 2.639 | 0.000 | 0.000 | 0.000 | 0.000 |
| KTINGSGSPHSKILRQQT | 3936 | 17.419 | 2.546 | 0.000 | 0.000 | 0.000 | 0.000 |
| KTINGSGSPHSFQINQQT | 3937 | 17.418 | 0.269 | 0.308 | 0.000 | 1.568 | 0.000 |
| KTINGSGSPHSKACISQT | 3938 | 17.371 | 0.240 | 0.000 | 0.000 | 0.000 | 0.000 |
| KTINGSGSPHSKAQTHRT | 3939 | 17.290 | 2.917 | 0.000 | 0.000 | 0.000 | 0.000 |
| KTINGSGSPHSKALRCQT | 3940 | 17.283 | 1.892 | 0.000 | 0.000 | 0.000 | 0.000 |
| KTINGSGSPHSKAFYIQT | 3941 | 17.172 | 0.239 | 0.000 | 0.000 | 0.000 | 0.000 |
| KTINGSGSPHSKAHARQT | 3942 | 17.075 | 1.800 | 0.000 | 0.000 | 0.000 | 0.000 |
| KTINGSGSPHSLCLNQQT | 3943 | 17.028 | 1.790 | 0.000 | 0.000 | 0.000 | 0.000 |
| KTINGSGSPHSKAFVRQT | 3944 | 16.935 | 1.985 | 0.000 | 0.000 | 0.000 | 0.000 |
| KPPLGSGSPHSKAQNQQT | 3945 | 16.897 | 0.805 | 0.000 | 0.000 | 0.000 | 0.000 |
| KTINGSGSPHRPWQNQQT | 3946 | 16.869 | 4.936 | 0.000 | 0.000 | 0.000 | 0.000 |
| KPARGSGSPHSKAQNQQT | 3947 | 16.793 | 1.391 | 0.000 | 0.000 | 0.000 | 0.000 |
| KTINGSGSPHRPRQNQQT | 3948 | 16.784 | 5.206 | 0.000 | 0.000 | 0.000 | 0.000 |
| KTINGSGSPHSCPQNQQT | 3949 | 16.701 | 1.776 | 0.000 | 0.000 | 0.000 | 0.000 |
| KTINGSGSPHSKAQFILT | 3950 | 16.650 | 4.208 | 0.000 | 0.000 | 0.000 | 0.000 |
| KTINGSSSPHWMAQNQQT | 4033 | 16.635 | 2.390 | 0.000 | 0.000 | 0.000 | 0.000 |
| KTRKRSGSPHSKAQNQQT | 4034 | 16.603 | 2.075 | 0.000 | 0.000 | 0.000 | 0.000 |
| KTINGSGSPHSVRYNQQT | 3951 | 16.390 | 1.413 | 0.000 | 0.000 | 0.000 | 0.000 |
| KSRRGSGSPHSKAQNQQT | 3952 | 16.131 | 1.446 | 0.000 | 0.000 | 0.000 | 0.000 |
| KTINGSGSPHSVRCNQQT | 3953 | 15.860 | 3.912 | 0.000 | 0.000 | 0.000 | 0.000 |
| KFFHGSGSPHSKAQNQQT | 3954 | 15.412 | 0.897 | 0.000 | 0.000 | 0.000 | 0.000 |
| KTINGSGSPHSKMPCQQT | 3955 | 15.343 | 1.063 | 0.000 | 0.000 | 0.000 | 0.000 |
| KTINGSGSPHSKKTSQQT | 3956 | 15.244 | 1.344 | 0.000 | 0.000 | 0.000 | 0.000 |
| KRYNGSGSPHSKAQNQQT | 3957 | 15.160 | 0.806 | 0.000 | 0.000 | 0.000 | 0.000 |
| KTINFTRSPHSKAQNQQT | 4035 | 14.908 | 3.751 | 0.000 | 0.000 | 0.000 | 0.000 |
| KTINGSGSPHSLPYNQQT | 3958 | 14.792 | 2.048 | 0.000 | 0.000 | 0.000 | 0.000 |
| KTINGSGSPHVYHQNQQT | 3959 | 14.770 | 1.733 | 0.000 | 0.000 | 0.000 | 0.000 |
| KTINGSGSPHSKAQSRKT | 3960 | 14.589 | 2.715 | 0.000 | 0.000 | 0.000 | 0.000 |
| KTINGSGSPHSYTRNQQT | 3961 | 14.535 | 1.986 | 0.000 | 0.000 | 0.000 | 0.000 |
| KTINNLRSPHSKAQNQQT | 4036 | 14.514 | 1.354 | 0.000 | 0.000 | 0.000 | 0.000 |
| KTINGRPSPHGKAQNQQT | 4037 | 14.442 | 0.705 | 0.000 | 0.000 | 0.000 | 0.000 |
| KTINWSRSPHSKAQNQQT | 4038 | 14.399 | 5.624 | 0.000 | 0.000 | 0.000 | 0.000 |
| KTINGSGSPHLVYQNQQT | 3962 | 14.196 | 1.045 | 0.000 | 0.000 | 0.000 | 0.000 |
| KTINGTRSPHKKAQNQQT | 4039 | 14.173 | 1.152 | 0.700 | 0.225 | 0.052 | 4.082 |

TABLE 17-continued

NGS fold-enrichment of TTM-001 and TTM-002 matured AAV capsid variants in the liver of NHPs

| Sequence | SEQ ID NO: | Fold Enrichment relative to AAV9 | | | | | |
|---|---|---|---|---|---|---|---|
| | | Liver RNA (NHP) | Liver DNA (NHP) | Brain (NHP) | DRG (NHP) | Heart (NHP) | Muscle (NHP) |
| KTINGSGSPHSKALRWQT | 3963 | 14.118 | 5.252 | 0.000 | 0.000 | 0.000 | 0.000 |
| KTINGSGSPHYRYQNQQT | 3964 | 14.107 | 1.027 | 0.000 | 0.000 | 0.000 | 0.000 |
| KTINGSGSPHSWLKNQQT | 3965 | 13.995 | 0.603 | 0.000 | 0.000 | 0.000 | 0.000 |
| KTINGSGSPHSKAQMQIT | 3966 | 13.990 | 0.371 | 0.000 | 0.000 | 0.000 | 0.000 |
| KTINGSVSPHCTAQNQQT | 4040 | 13.502 | 2.955 | 0.000 | 0.000 | 0.000 | 0.000 |
| KTINGSGSPHCPAQNQQT | 3967 | 13.359 | 1.409 | 0.000 | 0.000 | 0.000 | 0.000 |
| KTINGSGSPHSMCTNQQT | 3968 | 13.114 | 0.392 | 0.000 | 0.000 | 0.000 | 0.000 |
| KTINGSGSPHSPPDNQQT | 3969 | 12.973 | 0.033 | 0.000 | 0.000 | 0.000 | 0.000 |
| KTINGSGSPHSKRNYQQT | 3970 | 12.781 | 5.528 | 0.000 | 0.000 | 0.000 | 0.000 |
| KTTRCSGSPHSKAQNQQT | 4041 | 12.639 | 8.168 | 0.000 | 0.000 | 0.000 | 0.000 |
| KTKLCSGSPHSKAQNQQT | 4042 | 12.570 | 2.139 | 0.000 | 0.000 | 0.000 | 0.000 |
| KTINLGCSPHSKAQNQQT | 4043 | 12.564 | 0.654 | 0.000 | 0.000 | 0.000 | 0.000 |
| KTINGSGSPHRWTQNQQT | 3971 | 12.490 | 0.844 | 0.000 | 0.000 | 0.000 | 0.000 |
| KTISGHDSPHISGQYQQT | 4044 | 12.395 | 0.420 | 0.000 | 0.000 | 0.074 | 1214.588 |
| KTINGSGSPHSKACRLQT | 3972 | 12.297 | 6.537 | 0.000 | 0.000 | 0.000 | 0.000 |
| KTINGSGSPHPRKQNQQT | 3973 | 12.249 | 3.248 | 0.000 | 0.000 | 0.000 | 0.000 |
| KTINGSGSPHSKCSVQQT | 3974 | 12.246 | 1.465 | 0.000 | 0.000 | 0.000 | 0.000 |
| KTINGSGSPHSKAQYVRT | 3975 | 12.239 | 3.275 | 0.000 | 0.000 | 0.000 | 0.000 |
| KTINGSGSPHSKARISQT | 3976 | 12.142 | 1.565 | 0.000 | 0.000 | 0.000 | 0.000 |
| KTINGRRSPHMKAQNQQT | 4045 | 12.136 | 3.510 | 0.000 | 0.000 | 0.000 | 0.000 |
| KTINGPWSPHRKAQNQQT | 4046 | 12.103 | 0.434 | 0.000 | 0.000 | 0.000 | 0.000 |
| KTINGSGSPHPFVQNQQT | 3977 | 12.091 | 1.286 | 0.000 | 0.000 | 0.000 | 0.000 |
| KTINGSGSPHSKLPKQQT | 3978 | 11.856 | 0.274 | 0.000 | 0.000 | 0.000 | 0.000 |
| KTINSCFSPHSKAQNQQT | 4047 | 11.847 | 1.016 | 0.000 | 0.000 | 0.000 | 0.000 |
| KTINGSGSPHSKSEQQQT | 3979 | 11.785 | 1.769 | 0.000 | 0.000 | 0.000 | 0.000 |
| KTINGSGSPHWVAQNQQT | 3980 | 11.703 | 3.634 | 0.000 | 0.000 | 0.000 | 0.000 |
| KTINGSGSPHSLYQNQQT | 3981 | 11.590 | 1.503 | 0.000 | 0.000 | 0.000 | 0.000 |
| KTINGSGSPHSKVRMQQT | 3982 | 11.572 | 1.835 | 0.000 | 0.000 | 0.000 | 0.000 |
| KTINYTRSPHSKAQNQQT | 3983 | 11.514 | 0.431 | 0.000 | 0.000 | 0.000 | 0.000 |
| KTIKRYGSPHSKAQNQQT | 4048 | 11.461 | 2.022 | 0.000 | 0.000 | 0.000 | 0.000 |
| KTINGSGSPHCALQNQQT | 4693 | 11.404 | 3.867 | 0.000 | 0.000 | 0.000 | 0.000 |
| KTINGSGSPHSSCTNQQT | 3984 | 11.382 | 3.363 | 0.000 | 0.000 | 0.000 | 0.000 |
| KTINGSGSPHSKNSRQQT | 3985 | 11.280 | 1.093 | 0.000 | 0.000 | 0.000 | 0.000 |
| KTINGSGSPHSKRKRQQT | 3986 | 11.215 | 3.027 | 0.000 | 0.000 | 0.000 | 0.000 |
| KTINGSGSPHLCTQNQQT | 3987 | 11.176 | 2.489 | 0.000 | 0.000 | 0.000 | 0.000 |

TABLE 17-continued

NGS fold-enrichment of TTM-001 and TTM-002 matured AAV capsid variants in the liver of NHPs

| | | Fold Enrichment relative to AAV9 | | | | | |
|---|---|---|---|---|---|---|---|
| Sequence | SEQ ID NO: | Liver RNA (NHP) | Liver DNA (NHP) | Brain (NHP) | DRG (NHP) | Heart (NHP) | Muscle (NHP) |
| KTINGSGSPHSKAQSAKT | 3988 | 11.162 | 4.200 | 0.000 | 0.000 | 0.000 | 0.000 |
| KTINGSGSPHSTCLNQQT | 3989 | 11.132 | 4.762 | 0.000 | 0.000 | 0.000 | 0.000 |
| KTINGSGSPHSYARNQQT | 3990 | 11.131 | 0.996 | 0.000 | 0.000 | 0.000 | 0.000 |
| KTINGSGSPHSKQRPQQT | 3991 | 11.130 | 2.347 | 0.000 | 0.000 | 0.000 | 0.000 |
| KTINGSGSPHSKRVVQQT | 3992 | 11.094 | 1.639 | 0.000 | 0.000 | 0.000 | 0.000 |
| KRFSGSGSPHSKAQNQQT | 3993 | 11.024 | 1.358 | 0.000 | 0.000 | 0.000 | 0.000 |
| KTINGSGSPHKSGQNPQT | 3994 | 11.014 | 11.790 | 0.000 | 0.000 | 0.000 | 0.000 |
| KTINRYSSPHSKAQNQQT | 4049 | 10.926 | 1.544 | 0.000 | 0.000 | 0.000 | 0.000 |
| KTTGRSGSPHSKAQNQQT | 4050 | 10.863 | 0.126 | 0.000 | 0.000 | 0.000 | 0.000 |
| KTINGSGSPHSKALRHQT | 3995 | 10.774 | 4.532 | 0.000 | 0.000 | 0.000 | 0.000 |
| KTINGSGSPHSYYSNQQT | 3996 | 10.680 | 2.856 | 0.000 | 0.000 | 0.000 | 0.000 |
| KTINGSGSPHSLTCNQQT | 3997 | 10.658 | 2.214 | 0.490 | 0.000 | 0.163 | 1.398 |
| KTINGSGSPHSCQSNQQT | 3998 | 10.631 | 1.468 | 0.000 | 0.000 | 0.000 | 0.000 |
| KTINGSGSPHSKAQSIKT | 3999 | 10.544 | 1.355 | 0.000 | 0.000 | 0.000 | 0.000 |
| KYSMGSGSPHSKAQNQQT | 4000 | 10.478 | 1.587 | 0.000 | 0.000 | 0.000 | 0.000 |
| KTINGSGSPHSKAKGWQT | 4001 | 10.450 | 1.827 | 0.000 | 0.000 | 0.000 | 0.000 |
| KTIVGSGSPHSKPQNQQT | 4002 | 10.381 | 0.894 | 0.000 | 0.000 | 0.000 | 0.000 |
| KTINGSGSPHFPFQNQQT | 4003 | 10.322 | 3.715 | 0.000 | 0.000 | 0.000 | 0.000 |
| KPFLGSGSPHSKAQNQQT | 4004 | 10.318 | 1.328 | 0.000 | 0.000 | 0.000 | 0.000 |
| KTINGSGSPHSKCTSQQT | 4005 | 10.311 | 5.821 | 0.493 | 0.232 | 1.413 | 2.353 |
| KTINRQFSPHSKAQNQQT | 4051 | 10.275 | 4.480 | 0.000 | 0.000 | 0.000 | 0.000 |
| KTINGSGSPHSVFENQQT | 4006 | 10.218 | 0.224 | 0.000 | 0.000 | 0.000 | 0.000 |
| KTINGSGSPHSKAKKVQT | 4007 | 10.102 | 3.974 | 0.000 | 0.000 | 0.000 | 0.000 |
| KTINGSGSPHSKAQRCST | 4008 | 10.084 | 0.762 | 0.000 | 0.000 | 0.000 | 0.000 |

TABLE 17-continued

NGS fold-enrichment of TTM-001 and TTM-002 matured AAV capsid variants in the liver of NHPs

| Sequence | SEQ ID NO: | Fold Enrichment relative to AAV9 | | | | | |
|---|---|---|---|---|---|---|---|
| | | Liver RNA (NHP) | Liver DNA (NHP) | Brain (NHP) | DRG (NHP) | Heart (NHP) | Muscle (NHP) |
| KTINGSGSPHSKAQFCLT | 4009 | 10.065 | 3.371 | 0.000 | 0.000 | 0.000 | 0.000 |
| KTINGSGSPHGRYQNQQT | 4010 | 10.028 | 0.778 | 0.000 | 0.000 | 0.000 | 0.000 |

Table 18 provides the peptide sequences of 43 matured capsid variants having a raw virus count greater than 10, a CV of less than 1 for the heart samples isolated, and that also demonstrated a 4-fold or greater fold-increase in expression in the heart relative to the AAV9 control. A number of the matured variants shown in Table 18 also demonstrated increased expression in other tissues isolated from the NHPs, including the brain, muscle, and/or liver, and are therefore pan-tropic.

TABLE 18

NGS fold-enrichment of TTM-001 and TTM-002 matured AAV capsid variants in the heart of NHPs

| Sequence | SEQ ID NO: | Fold Enrichment relative to AAV9 | | | | | | |
|---|---|---|---|---|---|---|---|---|
| | | Heart (NHP) | Brain (NHP) | DRG (NHP) | Muscle (NHP) | Liver RNA (NHP) | Liver DNA (NHP) | Brain (Mouse) |
| KTITGHDSPHSKAQNQQT | 4052 | 34.375 | 230.437 | 4.338 | 1.378 | 19.165 | 5.672 | 0.000 |
| KTINGSGSPHKSGQYQQT | 4053 | 33.208 | 851.414 | 8.704 | 17.754 | 17.342 | 9.915 | 12.911 |
| KTINGSGSPHKSGQDQQT | 4054 | 31.166 | 218.057 | 34.358 | 33.372 | 27.081 | 8.836 | 24.849 |
| KTINGSGSPHKSGQIQQT | 4055 | 27.293 | 201.467 | 48.033 | 12.706 | 17.874 | 13.192 | 10.912 |
| KTINGSGSPHKSGRNQQT | 4056 | 27.283 | 313.826 | 8.723 | 36.593 | 15.252 | 12.352 | 21.595 |
| KTINGSGSPHKSGKNQQT | 4057 | 25.992 | 230.621 | 6.343 | 97.671 | 15.369 | 7.226 | 31.282 |
| KTIYGHDSPHSKAQNQQT | 4058 | 25.673 | 269.879 | 3.694 | 8.391 | 11.895 | 6.197 | 0.000 |
| KTINGSGSPHKSGQNQQS | 4059 | 24.783 | 244.030 | 16.675 | 26.058 | 18.059 | 9.809 | 29.751 |
| KTINGSGSPHKSGQNLQT | 4060 | 24.464 | 392.519 | 15.629 | 0.371 | 29.977 | 18.332 | 30.446 |
| KAINGHDSPHSKAQNQQT | 4061 | 22.460 | 640.466 | 7.358 | 9.986 | 9.358 | 8.490 | 0.000 |
| KTVNGHDSPHSKAQNQQT | 4062 | 21.066 | 614.034 | 3.392 | 30.908 | 21.560 | 11.933 | 121.235 |
| KTIKGHDSPHSKAQNQQT | 4063 | 20.803 | 213.564 | 24.646 | 12.361 | 15.379 | 6.551 | 13.319 |
| KSINGHDSPHSKAQNQQT | 4064 | 20.698 | 246.819 | 7.592 | 28.235 | 11.773 | 6.888 | 280.630 |
| KTINGSGSPHKSGQTQQT | 4065 | 19.925 | 466.459 | 55.454 | 15.485 | 15.473 | 6.446 | 15.179 |
| KTINGSGSPHKSGHNQQT | 4066 | 19.548 | 287.922 | 12.159 | 20.851 | 17.821 | 10.084 | 21.011 |
| KTFNGHDSPHSKAQNQQT | 4067 | 19.301 | 239.922 | 9.109 | 17.215 | 12.193 | 6.413 | 30.747 |
| KTINGSGSPHKSGLNQQT | 4068 | 19.136 | 319.093 | 3.083 | 4.096 | 14.009 | 7.446 | 9.340 |
| KTINGHDSPHSKALNQQT | 4069 | 18.542 | 605.641 | 13.375 | 1.902 | 12.621 | 7.054 | 51.283 |
| KTINGSGSPHKSGQNQLT | 4070 | 18.454 | 317.452 | 33.967 | 28.952 | 18.533 | 8.992 | 36.272 |
| KTLNGHDSPHSKAQNQQT | 4071 | 18.236 | 195.734 | 19.341 | 9.266 | 25.732 | 13.333 | 0.000 |
| KTINGSGSPHKSGQNQHT | 4072 | 14.269 | 313.837 | 7.125 | 39.273 | 29.714 | 7.797 | 25.119 |

TABLE 18-continued

NGS fold-enrichment of TTM-001 and TTM-002 matured AAV capsid variants in the heart of NHPs

| Sequence | SEQ ID NO: | Fold Enrichment relative to AAV9 | | | | | | |
|---|---|---|---|---|---|---|---|---|
| | | Heart (NHP) | Brain (NHP) | DRG (NHP) | Muscle (NHP) | Liver RNA (NHP) | Liver DNA (NHP) | Brain (Mouse) |
| KTIDGHDSPHSKAQNQQT | 4073 | 13.836 | 242.100 | 1.731 | 12.555 | 17.223 | 7.439 | 0.000 |
| KTNNGHDSPHSKAQNQQT | 4074 | 12.872 | 134.488 | 0.504 | 3.877 | 17.044 | 5.982 | 22.358 |
| KTINGSGSPHKSGQKQQT | 4075 | 12.357 | 323.373 | 10.936 | 1172.3 | 12.604 | 7.970 | 48.699 |
| KTINGSGSPHKSGQNRQT | 4076 | 11.563 | 145.363 | 36.865 | 3.855 | 11.403 | 7.667 | 16.860 |
| KTINGSGSPHKSGQNQQN | 4077 | 11.507 | 156.385 | 582.38 | 8.559 | 9.273 | 7.668 | 18.138 |
| KTINGSGSPHKSGQNQQA | 4078 | 11.313 | 135.164 | 12.425 | 12.699 | 9.714 | 6.077 | 17.265 |
| KTINGHDSPHSKAHNQQT | 4079 | 10.024 | 236.106 | 19.495 | 5.258 | 2.406 | 3.316 | 45.691 |
| KTINGHDSPHSKAQNQQT | 4080 | 8.954 | 186.839 | 9.457 | 5.507 | 5.929 | 3.651 | 31.453 |
| KTINGSGSPHKSGQNQQP | 4081 | 8.744 | 261.947 | 43.435 | 10.217 | 6.468 | 4.265 | 19.828 |
| KTINGHDSPHCKAQNQQT | 4082 | 8.417 | 15.165 | 0.887 | 2.368 | 3.328 | 0.771 | 148.172 |
| KTINGHDSPHSKAQNQQS | 4083 | 5.678 | 603.027 | 7.280 | 0.670 | 4.301 | 4.307 | 65.271 |
| KTINGSGSPHKSGQNQQT | 4084 | 5.586 | 115.994 | 28.397 | 4.326 | 5.307 | 3.569 | 24.908 |
| KTINGHDSPDKSGQNQQT | 4085 | 5.569 | 30.854 | 4.934 | 1.112 | 0.671 | 0.781 | 14.499 |
| KPINGHDSPHKSGQNHQS | 4086 | 5.203 | 36.266 | 0.000 | 0.258 | 4.478 | 0.521 | 28.786 |
| KTSNGSGSPHKSGQNQQT | 4087 | 4.746 | 197.282 | 4.177 | 4.466 | 3.972 | 7.425 | 75.623 |
| KTVNGSGSPHKSGQNQQT | 4088 | 4.610 | 200.076 | 2.739 | 2.873 | 2.725 | 3.478 | 43.548 |
| KTINGHDSTHKSGHNQQT | 4089 | 4.369 | 27.630 | 2.883 | 1.302 | 0.421 | 0.176 | 12.973 |
| KTINGHDSPHSKAQNQQN | 4090 | 4.271 | 319.610 | 1.163 | 5.173 | 3.406 | 4.995 | 50.220 |
| KTIYGSGSPHKSGQNQQT | 4091 | 4.140 | 110.329 | 2.603 | 2.545 | 4.488 | 4.110 | 29.293 |
| KTINGLDSQHKSGQNQQT | 4092 | 4.055 | 12.958 | 3.240 | 3.205 | 0.645 | 0.296 | 5.608 |

Table 19 provides the peptide sequences of 14 matured capsid variants having a raw virus count greater than 10, a CV of less than 1 for the muscle samples isolated (e.g., quadriceps), and that also demonstrated a 4-fold or greater fold-increase in expression in the muscle relative to the AAV9 control. A number of the matured variants shown in Table 19 also demonstrated increased expression in other tissues isolated from the NHPs, including the brain, heart, and/or liver, and are therefore pan-tropic.

TABLE 19

NGS fold-enrichment of TTM-001 and TTM-002 matured AAV capsid variants in the muscle (e.g., quadriceps) of NHPs

| Sequence | SEQ ID NO: | Fold Enrichment relative to AAV9 | | | | | | |
|---|---|---|---|---|---|---|---|---|
| | | Muscle (NHP) | Brain (NHP) | DRG (NHP) | Heart (NHP) | Liver RNA (NHP) | Liver DNA (NHP) | Brain (Mouse) |
| KTINGSGSPHKSGRNQQT | 4056 | 36.593 | 313.826 | 8.723 | 27.283 | 15.252 | 12.352 | 21.595 |
| KTIIGHDSPHSKAQNQQT | 4095 | 27.271 | 341.528 | 5.423 | 26.154 | 18.305 | 6.293 | 0.000 |
| KTIYGHDSPHSKAQNQQT | 4058 | 8.391 | 269.879 | 3.694 | 25.673 | 11.895 | 6.197 | 0.000 |

TABLE 19-continued

NGS fold-enrichment of TTM-001 and TTM-002 matured AAV capsid variants in the muscle (e.g., quadriceps) of NHPs

| | | Fold Enrichment relative to AAV9 | | | | | | |
|---|---|---|---|---|---|---|---|---|
| Sequence | SEQ ID NO: | Muscle (NHP) | Brain (NHP) | DRG (NHP) | Heart (NHP) | Liver RNA (NHP) | Liver DNA (NHP) | Brain (Mouse) |
| KTINGSGSPHKSGONQQS | 4059 | 26.058 | 244.030 | 16.675 | 24.783 | 18.059 | 9.809 | 29.751 |
| KTVNGHDSPHSKAQNQQT | 4062 | 30.908 | 614.034 | 3.392 | 21.066 | 21.560 | 11.933 | 121.235 |
| KTIKGHDSPHSKAQNQQT | 4063 | 12.361 | 213.564 | 24.646 | 20.803 | 15.379 | 6.551 | 13.319 |
| KSINGHDSPHSKAQNQQT | 4064 | 28.235 | 246.819 | 7.592 | 20.698 | 11.773 | 6.888 | 280.630 |
| KTINGSGSPHKSGHNQQT | 4066 | 20.851 | 287.922 | 12.159 | 19.548 | 17.821 | 10.084 | 21.011 |
| KTFNGHDSPHSKAQNQQT | 4067 | 17.215 | 239.922 | 9.109 | 19.301 | 12.193 | 6.413 | 30.747 |
| KTSNGHDSPHSKAQNQQT | 4096 | 18.580 | 507.189 | 7.777 | 17.770 | 21.537 | 8.789 | 70.219 |
| KTINGHDSPHSKAQNQQT | 4080 | 5.507 | 186.839 | 9.457 | 8.954 | 5.929 | 3.651 | 31.453 |
| KTINGSGSPHKSGONOQT | 4084 | 4.326 | 115.994 | 28.397 | 5.586 | 5.307 | 3.569 | 24.908 |
| KTINGHDSPHSKAQNQON | 4090 | 5.173 | 319.610 | 1.163 | 4.271 | 3.406 | 4.995 | 50.220 |
| KTINGSGSPHSKAQNRRR | 4097 | 4.237 | 8.348 | 0.291 | 0.636 | 1.597 | 5.396 | 158.853 |

Additional variants were identified following generation and screening in NHPs that had the following properties. TTM-001 and TTM-002 capsid variants comprising the amino acid sequence of SEQ ID NOs: 4253, 4281, 4290-4295, 4304, 4305, 4320, 4328-4335, 4337-4340, 4353, 4355, 4369, 4387, 4421, 4424-4428, 4430, 4432, 4433, 4435, 4436-4449, 4452, 4455, 4476, 4483, or 4484 had a raw virus count 10 or greater, a CV of less than 1 for the brain samples isolated from the NHPs, demonstrated a 50-fold or greater increase in expression in the brain of mice and NHPs relative to AAV9, and demonstrated 2-fold or less expression in the liver and DRG of NHPs relative to AAV9. TTM-001 and TTM-002 capsid variants comprising the amino acid sequence of SEQ ID NOs: 4098-4105, 4254-4280, 4282-4289, 4296-4303, 4306-4327, 4336, 4341-4352, 4354, 4356-4420, 4422, 4423, 4425, 4429, 4431, 4434, 4444, 4450, 4451, 4453, 4454, 4456-4475, 4477-4482, or 4485 had a CV of less than 1 in across the brain samples isolated from the NHPs and demonstrated a 100-fold or greater increase in expression in the brain of NHPs relative to AAV9. TTM-001 and TTM-002 capsid variants comprising the amino acid sequence of SEQ ID NOs: 4102 and 4106-4252 had normalized virus counts of greater than or equal to 0.01, a CV of less than 1 across the liver RNA samples isolated from the NHPs, and demonstrated a 20-fold or greater increase in expression in the liver of NHPs relative to AAV9. TM-001 and TTM-002 capsid variants comprising the amino acid sequence of SEQ ID NO: 4105 had a raw virus count 9.9 or greater, a CV of less than 1 across the muscle samples isolated from the NHPs, and 5-fold or greater increase in expression in the muscle of the NHPs relative to AAV9. TM-001 and TTM-002 capsid variants comprising the amino acid sequence of SEQ ID NO: 4105 also had a raw virus count 9.9 or greater, a CV of less than 1 across the samples isolated from the heart of the NHPs, and 5-fold or greater increase in expression in the heart of the NHPs relative to AAV9.

These data demonstrate that following two maturation approaches, matured TTM-001 and TTM-002 capsid variants (AAV9 capsid variants) with loop IV modifications were generated with significantly enhanced CNS tropism over wild-type AAV9 controls in both NHPs and mice, while also exhibiting de-targeting in peripheral tissues (e.g., the liver and DRG). These resulting matured variants therefore demonstrated cross-species CNS tropism in both NHPs and mice. Matured TTM-001 and TTM-002 capsid variants with liver-specific tropism were also generated with at least 10 times the expression compared to wild-type AAV9 in the liver of NHPs. Several matured variants were also generated with increased expression in the heart and skeletal muscle (e.g., quadriceps) relative to wild-type AAV9 in NHPs.

Example 5. Evaluation of TTM-001 and TTM-002 AAV Capsid Variants in Diverse Primate Species This Example evaluates the tropism and cross-species compatibility of the TTM-001 (SEQ ID NO: 981 (amino acid) and 983 (DNA), comprising SEQ ID NO: 941) and TTM-002 (SEQ ID NO: 982 (amino acid) and 984 (DNA), comprising SEQ ID NO: 2) capsid variants in two diverse primate species, marmosets (*Callithrix jacchus*) and African green monkeys (*Chlorocebus sabaeus*), as compared to their tropism in cynomolgus macaques (*Macaca fascicularis*) provided in Example 1. The cross-species compatibility and tropism of an AAV9 capsid variant comprising the amino acid sequence of SPHKYG (SEQ ID NO: 966) was also investigated in this example. The amino acid and DNA sequences of TTM-001 and TTM-002 are provided, e.g., in Tables 4 and 5, respectively.

To investigate tropism in African green monkeys, AAV particles comprising the TTM-001 capsid variant, the TTM-002 capsid variant, an AAV9 capsid variant comprising SEQ ID NO: 966, or an AAV9 control under the control of a synapsin promoter, were intravenously injected into NHPs (n=2, 3-12 years of age) at a dose of 2E13 vg/kg. After 14-days in life, the brains and tissues (liver, DRG, quadriceps, and heart) of the NHPs were collected and RNA was extracted. Following RNA recovery and RT-PCR amplification, a systematic NGS enrichment analysis was performed to calculate the fold enrichment ratio relative to the AAV9 wild-type control.

To investigate tropism in marmoset monkeys, AAV particles comprising the TTM-001 capsid variant, the TTM-002 capsid variant, an AAV9 capsid variant comprising SEQ ID NO: 966, or an AAV9 control, were intravenously injected into NHPs (n=2, >10 months of age) at a dose of 2E13 vg/kg (8.75E12 vg/mL). After 28-days in life, the brains and tissues (liver quadriceps, and heart) of the NHPs were collected and RNA was extracted. Following RNA recovery and RT-PCR amplification, a systematic NGS enrichment analysis was performed to calculate the fold enrichment ratio relative to the AAV9 wild-type control.

As provided in Table 20 (African green monkeys) and Table 21 (marmosets), both the TTM-001 and TTM-002 capsid variants demonstrated increased CNS tropism in diverse primate species. The TTM-001 capsid variant demonstrated a 73.6-fold increase in expression relative to AAV9 in the brain of cynomolgus macaques (Table 9, Example 1), a 43.5-fold increase in expression relative to AAV9 in the brain of African green monkeys, and a 703.3-fold increase in expression relative to AAV9 in the brain of marmosets. The TTM-002 capsid variant demonstrated a 62.6-fold increase in expression relative to AAV9 in the brain of cynomolgus macaques (Table 9), a 13.8-fold increase in expression relative to AAV9 in the brain of African green monkeys, and a 366.6-fold increase in expression relative to AAV9 in the brain of marmosets. Both TTM-001 and TTM-002 led to a significant increase in expression relative to AAV9 in the heart of both African green monkeys and marmosets (Table 20 and Table 21). The AAV9 capsid variant comprising SEQ ID NO: 966 also demonstrated in increase in expression relative to AAV9 in the brain and heart of both African green monkeys and marmosets. Furthermore, TTM-001, TTM-002, and the AAV9 capsid variant comprising SEQ ID NO: 966, also all led to increased expression in the brain of both BALB/c and C57Bl/6 mice (Table 11, Example 1), demonstrating an average fold change in expression relative to AAV9 across both species of mice of 63.1, 66.8, and 126.97, respectively.

TABLE 20

NGS-fold enrichment of TTM-001 (comprises SEQ ID NO: 941), TTM-002 (comprises SEQ ID NO: 2), and an AAV9 capsid variant comprising SEQ ID NO: 966 in African green monkeys

| Sequence | SEQ ID NO: | Fold Enrichment relative to AAV9 | | | | |
|---|---|---|---|---|---|---|
| | | Brain | DRG | Heart | Liver DNA | Liver RNA | Muscle |
| SPHSKA | 941 | 43.525 | 1.010 | 184.789 | 0.242 | 1.547 | 1.715 |
| HDSPHK | 2 | 13.779 | 0.678 | 35.991 | 0.084 | 0.087 | 0.144 |
| SPHKYG | 966 | 9.805 | 0.071 | 44.865 | 0.085 | 0.136 | 0.234 |

TABLE 21

NGS-fold enrichment of TTM-001 (comprises SEQ ID NO: 941), TTM-002 (comprises SEQ ID NO: 2), and an AAV9 capsid variant comprising SEQ ID NO: 966 in marmosets

| Sequence | SEQ ID NO: | Fold Enrichment relative to AAV9 | | | | |
|---|---|---|---|---|---|---|
| | | Brain | Heart | Liver DNA | Liver RNA | Muscle |
| SPHSKA | 941 | 703.610 | 48.979 | 0.268 | 0.779 | 0.425 |
| HDSPHK | 2 | 366.625 | 18.572 | 0.075 | 0.276 | 0.229 |
| SPHKYG | 966 | 150.209 | 17.232 | 0.045 | 0.014 | 0.146 |

Taken together, these data demonstrate that the AAV9 capsid variants of TTM-001 and TTM-002 demonstrated increased CNS tropism relative to the AAV9 control in the CNS across three diverse primate species and two species of mice, providing evidence of strong cross-species capacity. The AAV9 capsid variant comprising the amino acid sequence of SEQ ID NO: 966 also demonstrated strong CNS expression relative to the AAV9 control in two species of NHPs and two species of mice, also showing strong cross-species capacity.

Example 6. Advanced Maturation of TTM-002 Capsid Variant in Mice

This Example describes additional maturation of the TTM-002 (SEQ ID NO: 982 (amino acid) and 984 (DNA), comprising SEQ ID NO: 2) capsid variant in mice. In order to mature the TTM-002 capsid variant, sets of three contiguous amino acids were randomized across the mutagenesis region in TTM-002 sequence, which spanned from position 450 to position 466, numbered according to SEQ ID NO: 982. Unlike the maturation performed in in Example 3, where the SPH motif that was observed in the AAV capsid variants that demonstrated the greatest fold-enrichment in the NHP brain relative wild-type AAV9 was not disrupted, in the maturation approach used in this Example, the SPH motif was not held constant to further explore the role of this motif in the capsid variant. The matured TTM-002 capsid variants that resulted from the maturation approach were pooled together for subsequent testing and characterization in mice.

The library of matured AAV capsid variants generated from the TTM-002 matured AAV capsid variant were intravenously injected into the tail vein of three CD-1 Outbred mice (Charles River; 6-8 weeks of age) at a dose of $1.0 \times 10^{12}$ VG/dose. After about 28 days in life, the brains of the mice were isolated, and RNA was extracted. Following RNA recovery and RT-PCR amplification, a systematic NGS enrichment analysis was performed to calculate the fold enrichment ratio relative to the corresponding TTM-002 non-matured control, and the peptides comprised within the variants were identified. Variants were filtered by those with a raw virus count in the sample above 10 and a coefficient of variance (CV) that was greater than 1 (identifies the peptides/variants reliably detected in the majority of the samples isolated from the three mice).

Following the advanced maturation screen and filtering of the variants, 1302 variants demonstrated an increase in expression relative to the non-matured TTM-002 capsid variant in the brain of the outbred mice. Of the 1302 variants with improved tropism relative to the non-matured TTM-002, 1283 comprised the SPH motif in the same position as the non-matured TTM-002 capsid variant (e.g., immediately subsequent to position 455, relative to a reference sequence numbered according to the amino acid sequence of SEQ ID NO: 138 or 982). Mutations in the region of the SPH motif present in the non-matured TTM-002 capsid variant only consistently appear in those variants with a fold change of 0.2 or 0.1 or lower relative to the non-matured TTM-002 control in the brain of the mice. This indicates that the SPH motif may be important to the increased brain tropism that observed for the TTM-002 capsid variant. In instances when the SPH motif was disrupted, the fold change of the matured variants of TTM-002 decreased considerably in relation to the non-matured TTM-002 variant which comprised the SPH motif.

Example 7. Tropism of TTM-002 AAV Capsid Variant

This Example further investigates the tropism and CNS cells transduced by the TTM-002 capsid variant (SEQ ID NO: 982 (amino acid) and 984 (DNA), comprising SEQ ID NO: 2), as outlined in Table 3 above. The amino acid and DNA sequences of TTM-002 are provided, e.g., in Tables 4 and 5, respectively.

AAV particles were generated with the TTM-002 capsid variant encapsulating a GFP transgene (AAV_TTM-002.GFP) or a payload driven by a heterologous CBA constitutive promoter (AAV_TTM-002.Payload).

Two tandem single cell RNA sequencing runs (scRNA-Seq) of mouse cells derived from the midbrain area were performed. In the first run, cells were pooled from two mice at day 28 post treatment with AAV_TTM-002.Payload particles. In the second run we treated with AAV_TTM-002.GFP particles, in the same manner but without xenografts. Orthotopic xenografts of MDA-MB-361-Luc #1 high passage cells grown as tumorspheres (in tumorsphere media; Sigma #C-28070) were injected (250,000 cells/2 μL/mouse) intracranially into 2-month old female SCID CB17 (Mutation: Icr-Prkdcscid/IcrIcoCrl) congenic immunodeficient mice (Charles River Laboratories). The injections were 2.5 mm (lateral), −1 mm (posterior) with respect to bregma, lowered −3 mm ventral and raised +0.5 mm dorsal to a final −2.5 mm ventral position. Two days later, dilutions of the AAV_TTM-002.Payload particles (run 1), or in the case without xenografts, dilutions of AAV_TTM-002.GFP particles (run 2) were prepared. IV injections of 100 μL (2.5e11 VG/animal) of the AAV_TTM-002.payload particles or AAV_TTM-002.GFP particles were administered through the tail veins of mice (n=5 mice per groups). At 7 days post-injection, mice from run 1 were imaged in an AmiHTX (Spectral Imager) for bioluminescence of the human tumor cells due to expression of luciferase in response to intraperitoneal luciferin injections.

At 28 days post-injection with the AAV_TTM-002.payload particles or AAV_TTM-002.GFP particles, two mice from each run were necropsied, brain samples were isolated, and the midbrain was dissected and isolated. The midbrain samples were then exposed to a cold protease inhibitor (Creative Biomart #NATE-0633) and were dissociated at 6 degrees centigrade. For the samples collected from the mice of run 1 (AAV_TTM-002.Payload particles), myelin depletion was performed (Miltenyi, #130-096-731), cells were filtered through a 40 μM mesh to filter out neurons) and loaded on a 10× chromium G chip. scRNA-Seq was performed (10× Genomics) and samples were sequenced on a NextGen500 Sequencing machine (Illumina). For the samples collected from run 2 (AAV_TTM-002.GFP particles and no xenografts), the cells were not myelin depleted or filtered through 40 μM mesh to include neurons. The cells isolated after run 2 were FACS sorted for GFP+/7AAD− (live GFP+ cells). The resultant cells were loaded on a 10× chromium G chip and the scRNA-Seq was run and processed (10× Genomics).

For run 1, the scRNA-Seq data was filtered to include cells with only greater than 1000 genes per cell and less than 5000, and less than 20 percent mitochondrial gene expression. For run 2, the scRNA-Seq data was filtered to include cells with only greater than 200 genes per cell and less than 5000, and less than 20 percent mitochondrial gene expression. The data were normalized, scaled, and integrated into one combined dataset. Clusters were generated with a resolution of 0.3 and each cluster identity was determined using a panel of cell type specific genes (e.g., as described in Brown et al., 2021. "Deep Parallel Characterization of AAV Tropism and AAV-Mediated Transcriptional Changes via Single-Cell RNA Sequencing". *Front. Immunol.* 12:730825; the contents of which are hereby incorporated by reference in its entirety). The percentage of GFP sorted cells per cluster was calculated as was the percentage of payload expressing genes per cluster as parallel measures of TTM-002 transduction.

For payload expressing cells, endothelial cells had the highest proportion of payload positive cells, followed by astrocytes (Table 22). For GFP+ sorted cells, endothelial cells had the highest proportion of GFP positive cells, and astrocytes were the third highest cell type when sorting by proportion of cells expressing GFP (Table 22). These data indicate TTM-002 transduction exhibits an endothelial and astrocytic tropism. Furthermore, the astrocytic cluster had the second highest level of expression of Olig2 (oligodendrocytes demonstrated the greatest Olig2 expression). IHC staining was performed on brain samples isolated from AAV_TTM-002.GFP infected mice and demonstrated that GFP co-localized with some but not all Olig2+ cells. No co-staining was observed with mylein basic protein (MBP), a marker of oligodendrocytes. Co-staining with GFP was also not observed in NeuN positive cells (neurons), GFAP positive cells (astrocytes), and Iba1 positive cells (microglia). GFP staining was observed throughout the sagittal section of the mouse brain, which was demonstrative of increased staining in the midbrain. The GFP expressing cells observed did not have a bipolar morphology like oligodendrocyte progenitor (OPC) cells and therefore, together with the scRNA-Seq data, these results indicated that at day 28 post AAV treatment, Olig2+ astrocytes in the midbrain are being transduced by AAV particles comprising a TTM-002 capsid, in a cell type specific tropism.

TABLE 22

Quantification of payload positive cells and GFP positive cells

| Cluster Identity | % Payload Cells/Cluster | Cluster Identity | % GFP Cells/Cluster |
|---|---|---|---|
| Endothelial-2 | 6.58 | Endothelial-2 | 6.58 |
| Astrocyte | 4.50 | Endothelial-1 | 3.45 |
| Pericytes | 4.23 | Vascular and leptomeningeal Cells (VLM) | 2.38 |
| Mature Oligos | 3.85 | Astrocyte | 2.37 |
| Endothelial-1 | 3.09 | Vascular smooth muscle cells (VSC) | 1.03 |
| Committed Oligos | 1.90 | Pericytes | 0.77 |

TABLE 22-continued Quantification of payload positive cells and GFP positive cells

| Cluster Identity | % Payload Cells/Cluster | Cluster Identity | % GFP Cells/Cluster |
|---|---|---|---|
| Vascular smooth muscle cells (VSC) | 1.72 | Microglia | 0.00 |
| Microglia | 0.40 | Committed Oligos | 0.00 |
| Macrophages | 0.00 | Macrophages | 0.00 |
| Vascular and leptomeningeal cells (VLM) | 0.00 | Oligodendrocytes | 0.00 |
| Oligodendrocytes | 0.00 | Committed Oligos-2 | 0.00 |
| Committed Oligos-2 | 0.00 | Mature Oligos | 0.00 |

Example 8. Individual Capsid Characterization of TTM-002 in NHPs

This example describes the transduction level, tropism, ability to cross the blood brain barrier, and overall spatial distribution in the central nervous system (CNS) and peripheral tissues of the AAV capsid variant TTM-002 (SEQ ID NO: 982 (amino acid) and 984 (DNA), comprising SEQ ID NO: 2), relative to AAV9 following intravenous administration in African green monkeys (*Chlorocebus sabaeus*).

AAV particles were generated with the TTM-002 capsid variant or the AAV9 capsid control which comprised a self-complementary viral genome encoding an histone H2b protein with an HA tag driven by a ubiquitous CBA promoter. The AAV particles comprising the TTM-002 capsid variant or the AAV9 capsid control were administered to the NHPs (n=2) intravenously at a dose of 1e12 VG/kg or 1e13 VG/kg. The in-life period was 28 days and then various CNS and peripheral tissues were collected for measuring transgene mRNA (expression) by RT-qPCR and viral DNA (biodistribution) by ddPCR.

As shown in Table 23, the TTM-002 capsid variant resulted in increased brain biodistribution in all brain regions investigated as compared to AAV9 at both doses tested. The TTM-002 capsid variant also led to increased transgene expression in the brain relative to AAV9 at both doses tested (Table 24). In the spinal cord, the TTM-002 capsid variant distributed to the cervical spinal cord and the spinal cord ventral horn at a higher level relative to AAV9 (Table 23) and it mediated higher transgene expression than AAV9 in both the full spinal cord and the ventral horn (Table 24). The TTM-002 capsid variant exhibited lower biodistribution (Table 23) and transgene expression (Table 24) in the DRG relative to AAV9, indicating that TTM-002 capsid variant was detargeted in the DRG relative to AAV9. Similar expression and distribution were observed by immunohistochemistry performed on these CNS tissues.

Distribution and transgene expression was also measured in the peripheral tissues of the liver, heart, and quadriceps. In the liver, TTM-002 capsid variant exhibited lower biodistribution (Table 23) and transgene expression (Table 24) relative to AAV9, indicating that TTM-002 capsid variant was detargeted in the liver relative to AAV9. In the heart, the TTM-002 capsid variant exhibited comparable levels of biodistribution relative to AAV9 (Table 23), but increased transgene expression relative to AAV9 (Table 24). In the quadriceps, TTM-002 capsid variant exhibited lower biodistribution (Table 23) and lower transgene expression (Table 24), relative to AAV9. Similar expression and distribution were observed by immunohistochemistry performed on these peripheral tissues.

TABLE 23

Quantification of viral genome copies per diploid genome (biodistribution) by ddPCR following intravenous administration of AAV particles comprising a TTM-002 capsid

| | 1e12 VG/kg | | | 1e13 VG/kg | | |
|---|---|---|---|---|---|---|
| Tissue | AAV9 (VG copies/ diploid genome) | TTM-002 (VG copies/ diploid genome) | TTM-002 relative to AAV9 | AAV9 (VG copies/ diploid genome) | TTM-002 (VG copies/ diploid genome) | TTM-002 relative to AAV9 |
| Putamen | 0.03 | 0.37 | 12.3 | 0.26 | 2.4 | 9.2 |
| Caudate | 0.02 | 0.58 | 29 | 0.14 | 2.1 | 14.7 |
| Thalamus | 0.06 | 0.21 | 3.5 | 0.25 | 1.0 | 4 |
| Hippocampus | 0.03 | 0.29 | 9.7 | 0.16 | 1.56 | 9.8 |
| Substantia Nigra | 0.05 | 0.34 | 6.8 | 0.37 | 1.38 | 3.7 |
| Motor Cortex | 0.03 | 0.56 | 19 | 0.27 | 2.4 | 8.9 |
| Frontal Cortex | 0.04 | 0.67 | 17 | 0.20 | 3.6 | 18 |
| Temporal Cortex | 0.03 | 0.31 | 10 | 0.11 | 2.67 | 24 |
| Cerebral Cortex | 0.008 | 0.08 | 10 | 0.03 | 0.16 | 5.3 |
| Dentate Nucleus | 0.06 | 0.10 | 1.7 | 0.32 | 3.21 | 10 |
| Cervical Spinal Cord | 0.03 | 0.12 | 4 | 0.19 | 0.91 | 4.8 |
| Thoracic Spinal Cord | 0.04 | 0.03 | 0.75 | 0.36 | 0.38 | 1.1 |
| Lumbar Spinal Cord | 0.04 | 0.03 | 0.75 | 0.29 | 0.37 | 1.3 |
| C5 Ventral Horn | 0.04 | 0.25 | 6.3 | 0.29 | 2.2 | 7.6 |
| L5 Ventral Horn | 0.06 | 0.28 | 4.7 | 0.31 | 1.9 | 6.1 |
| Cervical DRG | 0.07 | 0.01 | −7 | 0.81 | 0.36 | −2.3 |
| Thoracic DRG | 0.06 | 0.01 | −6 | 1.31 | 0.43 | −3 |

TABLE 23-continued

Quantification of viral genome copies per diploid genome (biodistribution) by ddPCR following intravenous administration of AAV particles comprising a TTM-002 capsid

| | 1e12 VG/kg | | | 1e13 VG/kg | | |
| --- | --- | --- | --- | --- | --- | --- |
| Tissue | AAV9 (VG copies/ diploid genome) | TTM-002 (VG copies/ diploid genome) | TTM-002 relative to AAV9 | AAV9 (VG copies/ diploid genome) | TTM-002 (VG copies/ diploid genome) | TTM-002 relative to AAV9 |
| Lumbar DRG | 0.07 | 0.01 | −7 | 1.31 | 0.57 | −2.3 |
| Liver | 9.5 | 1.2 | −7.9 | 127 | 7.7 | −16.5 |
| Heart | 0.6 | 0.7 | 1.2 | 5.4 | 5.4 | 1 |
| Quadriceps | 0.2 | 0.06 | −3.3 | 1.7 | 0.6 | −2.8 |

TABLE 24

Quantification of transgene mRNA by RT-qPCR following intravenous administration of AAV particles comprising a TTM-002 capsid

| | 1e12 VG/kg | | | 1e13 VG/kg | | |
| --- | --- | --- | --- | --- | --- | --- |
| Tissue | AAV9 (transgene mRNA fold over housekeeping gene) (2-dCT) | TTM-002 (transgene mRNA fold over housekeeping gene) (2-dCT) | TTM-002 relative to AAV9 | AAV9 (transgene mRNA fold over housekeeping gene) (2-dCT) | TTM-002 (transgene mRNA fold over housekeeping gene) (2-dCT) | TTM-002 relative to AAV9 |
| Putamen | 0.02 | 0.3 | 15 | 0.09 | 4.22 | 47 |
| Caudate | 0.02 | 0.8 | 40 | 0.11 | 4.29 | 39 |
| Thalamus | 0.04 | 0.4 | 10 | 0.4 | 5.8 | 14.5 |
| Hippocampus | 0.02 | 0.4 | 20 | 0.1 | 4.3 | 43 |
| Substantia Nigra | 0.1 | 1.2 | 12 | 0.3 | 11.6 | 39 |
| Motor Cortex | 0.08 | 5.00 | 63 | 0.36 | 21.8 | 61 |
| Frontal Cortex | 0.04 | 3.1 | 78 | 0.3 | 27.7 | 92 |
| Temporal Cortex | 0.02 | 0.8 | 40 | 0.1 | 26.9 | 27 |
| Cerebral Cortex | 0.04 | 1.1 | 28 | 0.2 | 17.4 | 87 |
| Dentate Nucleus | 0.3 | 0.9 | 3 | 1.8 | 42.0 | 23 |
| Cervical Spinal Cord | 0.2 | 2.0 | 10 | 0.8 | 20.2 | 25 |
| Thoracic Spinal Cord | 0.13 | 0.25 | 1.9 | 0.7 | 4.8 | 6.9 |
| Lumbar Spinal Cord | 0.4 | 0.5 | 1.3 | 2.2 | 9.2 | 4.2 |
| C5 Ventral Horn | 0.2 | 1.4 | 7 | 1.7 | 33 | 19 |
| L5 Ventral Horn | 1.1 | 3.4 | 3.1 | 12.4 | 102 | 8.2 |
| Cervical DRG | 3.6 | 1.2 | −3 | 63.1 | 15.9 | −4 |
| Thoracic DRG | 1.8 | 1.3 | −1.4 | 43.9 | 15.7 | −2.8 |
| Lumbar DRG | 1.9 | 1.0 | −1.9 | 34.9 | 27.6 | −1.3 |
| Liver | 0.88 | 0.25 | −3.5 | 2.2 | 0.97 | −2.3 |
| Heart | 8.7 | 42 | 4.8 | 110 | 363 | 3.3 |
| Quadriceps | 9.7 | 1.1 | −8.3 | 59 | 21 | −2.8 |

Taken together, these data demonstrate that TTM-002 is an enhanced CNS tropic capsid in NHPs (African green monkeys) that can infect non-neuronal cells. TTM-002 was also detargeted in the DRG and liver relative to AAV9, but showed increased transgene expression in the heart relative to AAV9. Additionally, the TTM-002 capsid variant was able to successfully penetrate the blood brain barrier following intravenous injection.

SEQUENCE LISTING (6408 sequences)

SEQ ID NO: 1 - protein, 743 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 2 - protein, 6 aa, synthetic construct
HDSPHK

SEQ ID NO: 3 - DNA, 18 bp, synthetic construct
  source 1..18: mol_type = other DNA
cacgacagcccacacaaa

SEQ ID NO: 4-10 - skipped (7 entries)

SEQ ID NO: 11 - protein, 736 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 12 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacggagcgtgtgtctggttctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 13 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaaggcggagattggtcatgattctccgcataagtctggtcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttaatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 14 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgattattggttctggttctccgcattctaaggcgcagaatcgtcatacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 15 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacggagaagatgtctggttctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 16 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaaggagattaatggtcgtggttctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 17 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgtttaatggttctggttctccgcattctaaggcgccgaatctgcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 18 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacggagaagacgtctggttctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 19 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgatgaatggtcatgattctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 20 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgattgatggtcatgattctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 21 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgaataatggtcatgattctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 22 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgcagcgtaagtctggttctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 23 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgattaatggttctggttctccgcattctaaggcgcaggcgcgtaagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 24 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagtatattgtgggttctggttctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 25 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgatttctaagcgtggttctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 26 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagggtctgggtggttctggttctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 27 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgattaatggtcatgattctccgcattctaaggcgcagaatctgcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 28 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacggtgaatggtcatgattctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 29 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgattaatggtcatgattctccgcattctaaggcgctgaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 30 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgattaatggtcatgattctccgcattctaaggcgcagaatcagcagtctttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 31 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgattaatggtcatgattctccgcattctaaggcgcagaatcagcagattttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 32 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgattaatggttctggttctccgcattttacgcgtcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 33 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgtctaatggtcatgattctccgcattctaaggcgcagaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 34 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgattaatggttctggttctccgcattctctgccgtggaatcagcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 35 - DNA, 2226 bp, synthetic construct
  source 1..2226: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgatcagtatctgtattacttgagtaagacgattaatggtcatgattctccgcattctaaggcgcagaatcatcagacgttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaactta

SEQ ID NO: 36 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTERVSGSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 37 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKAEIGHDSPHKSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSLITQYSTGQVSVEIEWELQKENSKRWNPEIQYTSNYYKSNNVEFAVNTEGVYSEPRPIGTRYLTRNL

SEQ ID NO: 38 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIIGSGSPHSKAQNRHTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 39 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTEKMSGSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 40 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKEINGRGSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 41 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTFNGSGSPHSKAPNLQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 42 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTEKTSGSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 43 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTMNGHDSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 44 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTIDGHDSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 45 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTNNGHDSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTQRKSGSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 47 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGSPHSKAQARKTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 48 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKYIVGSGSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 49 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTISKRGSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 50 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKGLGGSGSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 51 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGHDSPHSKAQNLQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 52 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTVNGHDSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 53 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGHDSPHSKALNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 54 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGHDSPHSKAQNQQSLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 55 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGHDSPHSKAQNQQILKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 56 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGSPHFTRQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 57 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTSNGHDSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 58 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGSPHSLPWNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 59 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGHDSPHSKAQNHQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 60-136 - skipped (77 entries)

SEQ ID NO: 137 - DNA, 2211 bp, synthetic construct
  source 1..2211: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 138 - protein, 736 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 139-199 - skipped (61 entries)

SEQ ID NO: 200 - protein, 14 aa, synthetic construct
GSGSPHSKAQNQQT

SEQ ID NO: 201 - protein, 14 aa, synthetic construct
GHDSPHKSGQNQQT

SEQ ID NO: 202 - protein, 14 aa, synthetic construct
GSGSPHARMQNQQT

SEQ ID NO: 203 - protein, 14 aa, synthetic construct
GSGSPHVKSQNQQT

SEQ ID NO: 204 - protein, 14 aa, synthetic construct
GQDSPHKSGQNQQT

SEQ ID NO: 205 - protein, 14 aa, synthetic construct
GSGSPHASRQNQQT

SEQ ID NO: 206 - protein, 14 aa, synthetic construct
GSGSPHASRQNKQT

SEQ ID NO: 207 - protein, 14 aa, synthetic construct
GSGSPHVKIQNQQT

SEQ ID NO: 208 - protein, 14 aa, synthetic construct
GSGSPHSKAKNQQT

SEQ ID NO: 209 - protein, 14 aa, synthetic construct
GSGSPHKKNQNQQT

SEQ ID NO: 210 - protein, 14 aa, synthetic construct
GSGSPHVRMQNQQT

SEQ ID NO: 211 - protein, 14 aa, synthetic construct
GSGSPHASRQKQQT

SEQ ID NO: 212 - protein, 14 aa, synthetic construct
GHSSPHRSGQNQQT

SEQ ID NO: 213 - protein, 14 aa, synthetic construct
GMRTYHLSGQNQQT

SEQ ID NO: 214 - protein, 14 aa, synthetic construct
GSGSPHTRGQNQQT

SEQ ID NO: 215 - protein, 14 aa, synthetic construct
GSGIIPVSSQNQQT

SEQ ID NO: 216 - protein, 14 aa, synthetic construct
GSEYGHKSGQNQQT

SEQ ID NO: 217 - protein, 14 aa, synthetic construct
GRGQNVSSVHRQQT

SEQ ID NO: 218 - protein, 14 aa, synthetic construct
GSSHRFYGGQNQQT

SEQ ID NO: 219 - protein, 14 aa, synthetic construct
GYFVAAWSGQNQQT

SEQ ID NO: 220 - protein, 14 aa, synthetic construct
GSVLHSHAAQNQQT

SEQ ID NO: 221 - protein, 14 aa, synthetic construct
GSGDLVVSTQNQQT

SEQ ID NO: 222 - protein, 14 aa, synthetic construct
GSYGMAASGQNQQT

SEQ ID NO: 223 - protein, 14 aa, synthetic construct
GLNHFGASGQNQQT

SEQ ID NO: 224 - protein, 14 aa, synthetic construct
GSTGSHSAGQNQHT

SEQ ID NO: 225 - protein, 14 aa, synthetic construct
GLAGHTVSGQNQQT

SEQ ID NO: 226 - protein, 14 aa, synthetic construct
GIILGASSGQNQQT

SEQ ID NO: 227 - protein, 14 aa, synthetic construct
GSGVSTYNIQNQQT

SEQ ID NO: 228 - protein, 14 aa, synthetic construct
GSLVSVQTGQNQQT

SEQ ID NO: 229 - protein, 14 aa, synthetic construct
GQSSPHRSGQNQQT

SEQ ID NO: 230 - protein, 14 aa, synthetic construct
GREYGHKSGQNQQT

SEQ ID NO: 231 - protein, 14 aa, synthetic construct
GHTLTLSSGQNQQT

SEQ ID NO: 232 - protein, 14 aa, synthetic construct
GSITLIPSGQNQQT

SEQ ID NO: 233 - protein, 14 aa, synthetic construct
GSNGFTALGQNQQT

SEQ ID NO: 234 - protein, 14 aa, synthetic construct
GSGHSSHSVQNQQT

SEQ ID NO: 235 - protein, 14 aa, synthetic construct
GSGIPQRSGKNQQT

SEQ ID NO: 236 - protein, 14 aa, synthetic construct
GSGDTLHMLQNQQT

SEQ ID NO: 237 - protein, 14 aa, synthetic construct
GERHTVLSGQNQQT

SEQ ID NO: 238 - protein, 14 aa, synthetic construct
GSGMPQSHIQNQQT

SEQ ID NO: 239 - protein, 14 aa, synthetic construct
GSGQLSGIGGNQQT

SEQ ID NO: 240 - protein, 14 aa, synthetic construct
GSGQNRKPASFAQT

SEQ ID NO: 241 - protein, 14 aa, synthetic construct
GSGSVSQLGQNQQT

SEQ ID NO: 242 - protein, 14 aa, synthetic construct
GSDFLGTHGQNQQT

SEQ ID NO: 243 - protein, 14 aa, synthetic construct
GQIVQNPSGQNQQT

SEQ ID NO: 244 - protein, 14 aa, synthetic construct
GSGTQIPSQQNQQT

SEQ ID NO: 245 - protein, 14 aa, synthetic construct
GSGQNQQSAREGLT

SEQ ID NO: 246 - protein, 14 aa, synthetic construct
GSGLGMSTGQNQQT

SEQ ID NO: 247 - protein, 14 aa, synthetic construct
GSGLPVLSGQNQQT

SEQ ID NO: 248 - protein, 14 aa, synthetic construct
GSGHSIRTDQNQQT

SEQ ID NO: 249 - protein, 14 aa, synthetic construct
GSGQSVQTVVNQQT

SEQ ID NO: 250 - protein, 14 aa, synthetic construct
GSGQNRAQSRFQQT

SEQ ID NO: 251 - protein, 14 aa, synthetic construct
GGGDLGRSSQNQQT

SEQ ID NO: 252 - protein, 14 aa, synthetic construct
GGGTKMDSGQNQQT

SEQ ID NO: 253 - protein, 14 aa, synthetic construct
GSGSPHPSRQNQQT

SEQ ID NO: 254 - protein, 14 aa, synthetic construct
GSGQFTNAGMNQQT

SEQ ID NO: 255 - protein, 14 aa, synthetic construct
GGRNGHTVGQNQQT

SEQ ID NO: 256 - protein, 14 aa, synthetic construct
GSGFGPQTGQNQQT

SEQ ID NO: 257 - protein, 14 aa, synthetic construct
GRTDSHTSGQNQQT

SEQ ID NO: 258 - protein, 14 aa, synthetic construct
GYEVLGSSGQNQQT

SEQ ID NO: 259 - protein, 14 aa, synthetic construct
GSVHLSVTGQNQQT

SEQ ID NO: 260 - protein, 14 aa, synthetic construct
GFMSYKGSGQNQQT

SEQ ID NO: 261 - protein, 14 aa, synthetic construct
GNIAGSVSGQNQQT

SEQ ID NO: 262 - protein, 14 aa, synthetic construct
GSGSHRDVSQNQQT

SEQ ID NO: 263 - protein, 14 aa, synthetic construct
GGLGSMSSGQNQQT

SEQ ID NO: 264 - protein, 14 aa, synthetic construct
GSGHLPQSAQNQQT

SEQ ID NO: 265 - protein, 14 aa, synthetic construct
GGVLVGGSGQNQQT

SEQ ID NO: 266 - protein, 14 aa, synthetic construct
GTHPYTSSGQNQQT

SEQ ID NO: 267 - protein, 14 aa, synthetic construct
GSGQNQQLKENRST

SEQ ID NO: 268 - protein, 14 aa, synthetic construct
GSGQNQQTSPHNHT

SEQ ID NO: 269 - protein, 14 aa, synthetic construct
GSGTLYPQSQNQQT

SEQ ID NO: 270 - protein, 14 aa, synthetic construct
GSGQNQQSNWITKT

SEQ ID NO: 271 - protein, 14 aa, synthetic construct
GSGYTSLFLQNQQT

SEQ ID NO: 272 - protein, 14 aa, synthetic construct
GSGVMTHVLQNQQT

SEQ ID NO: 273 - protein, 14 aa, synthetic construct
GSVSDVRAGQNQQT

SEQ ID NO: 274 - protein, 14 aa, synthetic construct
GSGQSHMATLNQQT

SEQ ID NO: 275 - protein, 14 aa, synthetic construct
GSGLSVHLAQNQQT

SEQ ID NO: 276 - protein, 14 aa, synthetic construct
GSGLSHATQQNQQT

SEQ ID NO: 277 - protein, 14 aa, synthetic construct
GSGLSVQSGQNQQT

SEQ ID NO: 278 - protein, 14 aa, synthetic construct
GSGHMTYREKNQQT

SEQ ID NO: 279 - protein, 14 aa, synthetic construct
GSKGVPTPGQNQQT

SEQ ID NO: 280 - protein, 14 aa, synthetic construct
GSGLLPLSSQNQQT

SEQ ID NO: 281 - protein, 14 aa, synthetic construct
GNGLYAVSGQNQQT

SEQ ID NO: 282 - protein, 14 aa, synthetic construct
GFNGSPSSGQNQQT

SEQ ID NO: 283 - protein, 14 aa, synthetic construct
GSGQIRHSDQNQQT

SEQ ID NO: 284 - protein, 14 aa, synthetic construct
GGQVAPSSGQNQQT

SEQ ID NO: 285 - protein, 14 aa, synthetic construct
GSFSMHTHGQNQQT

SEQ ID NO: 286 - protein, 14 aa, synthetic construct
GSGQNQQVIQGSNT

SEQ ID NO: 287 - protein, 14 aa, synthetic construct
GRVLHSHAGQNQQT

SEQ ID NO: 288 - protein, 14 aa, synthetic construct
GSGQNQQTSLQDQT

SEQ ID NO: 289 - protein, 14 aa, synthetic construct
GSGLGRAPVQNQQT

SEQ ID NO: 290 - protein, 14 aa, synthetic construct
GNGFSSASGQNQQT

SEQ ID NO: 291 - protein, 14 aa, synthetic construct
GSGQMASRESNQQT

SEQ ID NO: 292 - protein, 14 aa, synthetic construct
GPGLPNHSGQNQQT

SEQ ID NO: 293 - protein, 14 aa, synthetic construct
GNIQWQGSGQNQQT

SEQ ID NO: 294 - protein, 14 aa, synthetic construct
GMSAHMSSGQNQQT

SEQ ID NO: 295 - protein, 14 aa, synthetic construct
GHSFVNRSGQNQQT

SEQ ID NO: 296 - protein, 14 aa, synthetic construct
GRAVMDHSGQNQQT

SEQ ID NO: 297 - protein, 14 aa, synthetic construct
GALTVMQSGQNQQT

SEQ ID NO: 298 - protein, 14 aa, synthetic construct
GSGQRSPVLPNQQT

SEQ ID NO: 299 - protein, 14 aa, synthetic construct
GSGQNGHLSLKQQT

SEQ ID NO: 300 - protein, 14 aa, synthetic construct
GSLPRGTSDQNQQT

SEQ ID NO: 301 - protein, 14 aa, synthetic construct
GVAGSLVSGQNQQT

SEQ ID NO: 302 - protein, 14 aa, synthetic construct
GRGGIPQSGQNQQT

SEQ ID NO: 303 - protein, 14 aa, synthetic construct
GSGQYASSIPNQQT

SEQ ID NO: 304 - protein, 14 aa, synthetic construct
GTDFGRQSSQNQQT

SEQ ID NO: 305 - protein, 14 aa, synthetic construct
GIFMQTPSGQNQQT

SEQ ID NO: 306 - protein, 14 aa, synthetic construct
GSGQNQQTRLVDLT

SEQ ID NO: 307 - protein, 14 aa, synthetic construct
GTREMPLSGQNQQT

SEQ ID NO: 308 - protein, 14 aa, synthetic construct
GSRLVHVHGQNQQT

SEQ ID NO: 309 - protein, 14 aa, synthetic construct
GSGRLVPNGPNQQT

SEQ ID NO: 310 - protein, 14 aa, synthetic construct
GSGYLRESPQNQQT

SEQ ID NO: 311 - protein, 14 aa, synthetic construct
GARIQNASGQKQQT

SEQ ID NO: 312 - protein, 14 aa, synthetic construct
GLSNPMPSGQNQQT

SEQ ID NO: 313 - protein, 14 aa, synthetic construct
GSTVQDTRGQNQQT

SEQ ID NO: 314 - protein, 14 aa, synthetic construct
GPFGMPSSGQNQQT

SEQ ID NO: 315 - protein, 14 aa, synthetic construct
GSGQNHGVLSNQQT

SEQ ID NO: 316 - protein, 14 aa, synthetic construct
GSGYSMSQAQNQQT

SEQ ID NO: 317 - protein, 14 aa, synthetic construct
GSGMLTHTLQNQQT

SEQ ID NO: 318 - protein, 14 aa, synthetic construct
GRGSPHASRQNQQT

SEQ ID NO: 319 - protein, 14 aa, synthetic construct
GLSWPSTSGQNQQT

SEQ ID NO: 320 - protein, 14 aa, synthetic construct
GNSMERTSGQNQQT

SEQ ID NO: 321 - protein, 14 aa, synthetic construct
GSGMSPSTLQNQQT

SEQ ID NO: 322 - protein, 14 aa, synthetic construct
GSGHGQVLSQNQQT

SEQ ID NO: 323 - protein, 14 aa, synthetic construct
GRGQIYSTGGNQQT

SEQ ID NO: 324 - protein, 14 aa, synthetic construct
GVVAAHNSGQNQQT

SEQ ID NO: 325 - protein, 14 aa, synthetic construct
GDSSLRHSGQNQQT

SEQ ID NO: 326 - protein, 14 aa, synthetic construct
GSLVSQGAGQNQQT

SEQ ID NO: 327 - protein, 14 aa, synthetic construct
GSLLQAHSGQNQQT

SEQ ID NO: 328 - protein, 14 aa, synthetic construct
GSGHIYVGIQNQQT

SEQ ID NO: 329 - protein, 14 aa, synthetic construct
GHHTTVQSGQNQQT

SEQ ID NO: 330 - protein, 14 aa, synthetic construct
GSRQSKRNELNQQT

SEQ ID NO: 331 - protein, 14 aa, synthetic construct
GSGQNQQHVSSPRT

SEQ ID NO: 332 - protein, 14 aa, synthetic construct
GSSKELLWGQNQQT

SEQ ID NO: 333 - protein, 14 aa, synthetic construct
GSLSTPSSGQNQQT

SEQ ID NO: 334 - protein, 14 aa, synthetic construct
GSIGYAGQGQNQQT

SEQ ID NO: 335 - protein, 14 aa, synthetic construct
GSGQNQRVSNSQQT

SEQ ID NO: 336 - protein, 14 aa, synthetic construct
GSGYASHVQQNQQT

SEQ ID NO: 337 - protein, 14 aa, synthetic construct
GSGEYSRSGQNQQT

SEQ ID NO: 338 - protein, 14 aa, synthetic construct
GSVSTHSSGQNQQT

SEQ ID NO: 339 - protein, 14 aa, synthetic construct
GSGQNQHSLGNYQT

SEQ ID NO: 340 - protein, 14 aa, synthetic construct
GSGGLDTRGQNQQT

SEQ ID NO: 341 - protein, 14 aa, synthetic construct
GNILHATSGQNQQT

SEQ ID NO: 342 - protein, 14 aa, synthetic construct
GSGQSYTMTQNQQT

SEQ ID NO: 343 - protein, 14 aa, synthetic construct
GSGQNQHSAPNSQT

SEQ ID NO: 344 - protein, 14 aa, synthetic construct
GSGQNQQTMDHNRT

SEQ ID NO: 345 - protein, 14 aa, synthetic construct
GSNGGVGTGQNQQT

SEQ ID NO: 346 - protein, 14 aa, synthetic construct
GAGSIIPSGQNQQT

SEQ ID NO: 347 - protein, 14 aa, synthetic construct
GSGQTHGGQHNQQT

SEQ ID NO: 348 - protein, 14 aa, synthetic construct
GSNLSFQSGQNQQT

SEQ ID NO: 349 - protein, 14 aa, synthetic construct
GATLQVHSGQNQQT

SEQ ID NO: 350 - protein, 14 aa, synthetic construct
GSGFNQRSEQNQQT

SEQ ID NO: 351 - protein, 14 aa, synthetic construct
GSGSLRDFDQNQQT

SEQ ID NO: 352 - protein, 14 aa, synthetic construct
GSGDSITGKQNQQT

SEQ ID NO: 353 - protein, 14 aa, synthetic construct
GSGQDRNIVQNQQT

SEQ ID NO: 354 - protein, 14 aa, synthetic construct
GSGLSHSHQQNQQT

SEQ ID NO: 355 - protein, 14 aa, synthetic construct
GSGQNQQTGMSSVK

SEQ ID NO: 356 - protein, 14 aa, synthetic construct
GSVTHGISGQNQQT

SEQ ID NO: 357 - protein, 14 aa, synthetic construct
GVVAHQPSGQNQQT

SEQ ID NO: 358 - protein, 14 aa, synthetic construct
GSGPILGQLQNQQT

SEQ ID NO: 359 - protein, 14 aa, synthetic construct
GSGHVPNSGLNQQT

SEQ ID NO: 360 - protein, 14 aa, synthetic construct
GDAGVRSSGQNQQT

SEQ ID NO: 361 - protein, 14 aa, synthetic construct
GSGSQLMSLQNQQT

SEQ ID NO: 362 - protein, 14 aa, synthetic construct
GSGLDYSQRQNQQT

SEQ ID NO: 363 - protein, 14 aa, synthetic construct
GSGQSSGRLINKQT

SEQ ID NO: 364 - protein, 14 aa, synthetic construct
GSSVSPSSGQNQQT

SEQ ID NO: 365 - protein, 14 aa, synthetic construct
GSGQVVGLSGNQQT

SEQ ID NO: 366 - protein, 14 aa, synthetic construct
GSNMGVPLGQNQQT

SEQ ID NO: 367 - protein, 14 aa, synthetic construct
GSFYPSSTGQNQQT

SEQ ID NO: 368 - protein, 14 aa, synthetic construct
GSGQNQQTRLTDLT

SEQ ID NO: 369 - protein, 14 aa, synthetic construct
GPTNGRSSGQNQQT

SEQ ID NO: 370 - protein, 14 aa, synthetic construct
GSGLLHGKLQNQQT

SEQ ID NO: 371 - protein, 14 aa, synthetic construct
GANMGHVSGQNQQT

SEQ ID NO: 372 - protein, 14 aa, synthetic construct
GSGQNQQSGRGDLT

SEQ ID NO: 373 - protein, 14 aa, synthetic construct
GSHGHYASGQKQQT

SEQ ID NO: 374 - protein, 14 aa, synthetic construct
GSGDLRISPQNQQT

SEQ ID NO: 375 - protein, 14 aa, synthetic construct
GSGMPVILGQNQQT

SEQ ID NO: 376 - protein, 14 aa, synthetic construct
GRGVITSSGQNHQT

SEQ ID NO: 377 - protein, 14 aa, synthetic construct
GSGHSVSGPQNQQT

SEQ ID NO: 378 - protein, 14 aa, synthetic construct
GSRNGHTVGRNQQT

SEQ ID NO: 379 - protein, 14 aa, synthetic construct
GAGVHMVSGQNQQT

SEQ ID NO: 380 - protein, 14 aa, synthetic construct
GSGQNHRPSVLQQT

SEQ ID NO: 381 - protein, 14 aa, synthetic construct
GSGSPRDSIQNQQT

SEQ ID NO: 382 - protein, 14 aa, synthetic construct
GSGQGIHSSVNQQT

SEQ ID NO: 383 - protein, 14 aa, synthetic construct
GSGQQLSITPNQQT

SEQ ID NO: 384 - protein, 14 aa, synthetic construct
GGYHSQTSGQNQQT

SEQ ID NO: 385 - protein, 14 aa, synthetic construct
GSLHHDNHGQNQQT

SEQ ID NO: 386 - protein, 14 aa, synthetic construct
GIMARDSSGQNQQT

SEQ ID NO: 387 - protein, 14 aa, synthetic construct
GVVHITNSGQNQQT

SEQ ID NO: 388 - protein, 14 aa, synthetic construct
GSGQNQHSAPFNQT

SEQ ID NO: 389 - protein, 14 aa, synthetic construct
GSGQTSGLKQNQQT

SEQ ID NO: 390 - protein, 14 aa, synthetic construct
GSGQNQQTSLSNTA

SEQ ID NO: 391 - protein, 14 aa, synthetic construct
GSGQNQAVHNKSQT

SEQ ID NO: 392 - protein, 14 aa, synthetic construct
GVHTHLPSGQNQQT

SEQ ID NO: 393 - protein, 14 aa, synthetic construct
GHLTMHNSGQNHQT

SEQ ID NO: 394 - protein, 14 aa, synthetic construct
GSGSSSRPYQNQQT

SEQ ID NO: 395 - protein, 14 aa, synthetic construct
GILLATPSGQNQQT

SEQ ID NO: 396 - protein, 14 aa, synthetic construct
GSGQNAGSFPNQQT

SEQ ID NO: 397 - protein, 14 aa, synthetic construct
GSRDGHTVGQNQQT

SEQ ID NO: 398 - protein, 14 aa, synthetic construct
GSLLISTSGQNQQT

SEQ ID NO: 399 - protein, 14 aa, synthetic construct
GSGAMPSHGQNQQT

SEQ ID NO: 400 - protein, 14 aa, synthetic construct
GALVSPISGQNQQT

SEQ ID NO: 401 - protein, 14 aa, synthetic construct
GSLSSHGVGQNQQT

SEQ ID NO: 402 - protein, 14 aa, synthetic construct
GSGQNQQASLAMRT

SEQ ID NO: 403 - protein, 14 aa, synthetic construct
GPGLGSHSGQNQQT

SEQ ID NO: 404 - protein, 14 aa, synthetic construct
GHDSQHKSGQNQQT

SEQ ID NO: 405 - protein, 14 aa, synthetic construct
GSGLTLSATQNQQT

SEQ ID NO: 406 - protein, 14 aa, synthetic construct
GSGQVVAHVGNQQT

SEQ ID NO: 407 - protein, 14 aa, synthetic construct
GSGLRTMTTQNQQT

SEQ ID NO: 408 - protein, 14 aa, synthetic construct
GSGQVGRLLQNQQT

SEQ ID NO: 409 - protein, 14 aa, synthetic construct
GSGQLSHQSVNQQT

SEQ ID NO: 410 - protein, 14 aa, synthetic construct
GSGDRYQTLQNQQT

SEQ ID NO: 411 - protein, 14 aa, synthetic construct
GSGQNQQLKSSAQT

SEQ ID NO: 412 - protein, 14 aa, synthetic construct
GSGQNQYSIPVAQT

SEQ ID NO: 413 - protein, 14 aa, synthetic construct
GSGERLHLTQNQQT

SEQ ID NO: 414 - protein, 14 aa, synthetic construct
GSGHNQQVRTAPNT

SEQ ID NO: 415 - protein, 14 aa, synthetic construct
GGLSHVMSGQNQQT

SEQ ID NO: 416 - protein, 14 aa, synthetic construct
GSGQSHRDVLNQQT

SEQ ID NO: 417 - protein, 14 aa, synthetic construct
GSGQNLAGRMDQQT

SEQ ID NO: 418 - protein, 14 aa, synthetic construct
GSGQNQQTNRGNPM

SEQ ID NO: 419 - protein, 14 aa, synthetic construct
GSGQSYQRDHNQQT

SEQ ID NO: 420 - protein, 14 aa, synthetic construct
GSLLSAGMGQNQHT

SEQ ID NO: 421 - protein, 14 aa, synthetic construct
GSGQNQQTAIYRNI

SEQ ID NO: 422 - protein, 14 aa, synthetic construct
GSGQNQQTSGTTNC

SEQ ID NO: 423 - protein, 14 aa, synthetic construct
GMTSHSVSGQNQQT

SEQ ID NO: 424 - protein, 14 aa, synthetic construct
GSSQSTGYQPNQQT

SEQ ID NO: 425 - protein, 14 aa, synthetic construct
GSLKPTTLGQNQQT

SEQ ID NO: 426 - protein, 14 aa, synthetic construct
GRMFSLGSGQNQQT

SEQ ID NO: 427 - protein, 14 aa, synthetic construct
GSGQNQQTALGVKC

SEQ ID NO: 428 - protein, 14 aa, synthetic construct
GAMVSHSSGQNQQT

SEQ ID NO: 429 - protein, 14 aa, synthetic construct
GSGQNQQRNSDSVT

SEQ ID NO: 430 - protein, 14 aa, synthetic construct
GSGQSMTLHLNQQT

SEQ ID NO: 431 - protein, 14 aa, synthetic construct
GSGQVHQAEVNQQT

SEQ ID NO: 432 - protein, 14 aa, synthetic construct
GSGQNQSQNHLQQT

SEQ ID NO: 433 - protein, 14 aa, synthetic construct
GSLLTTASGQNQQT

SEQ ID NO: 434 - protein, 14 aa, synthetic construct
GSGLIRTAAQNQQT

SEQ ID NO: 435 - protein, 14 aa, synthetic construct
GSGQNQQTVSRQST

SEQ ID NO: 436 - protein, 14 aa, synthetic construct
GSGQYANHGINQQT

SEQ ID NO: 437 - protein, 14 aa, synthetic construct
GSRSTGPSGQNQQT

SEQ ID NO: 438 - protein, 14 aa, synthetic construct
GRGVQQKLQQNQQT

SEQ ID NO: 439 - protein, 14 aa, synthetic construct
GSGQNQQVHLSTGT

SEQ ID NO: 440 - protein, 14 aa, synthetic construct
GSGQNQQLSAKSST

SEQ ID NO: 441 - protein, 14 aa, synthetic construct
GSGYKAARPQNQQT

SEQ ID NO: 442 - protein, 14 aa, synthetic construct
GSAGISPSGQNQQT

SEQ ID NO: 443 - protein, 14 aa, synthetic construct
GSGQNRAHAFLQQT

SEQ ID NO: 444 - protein, 14 aa, synthetic construct
GSGLSGITMQNQQT

SEQ ID NO: 445 - protein, 14 aa, synthetic construct
GPGSAHSSGQNQQT

SEQ ID NO: 446 - protein, 14 aa, synthetic construct
GSSHTQALGQNQQT

SEQ ID NO: 447 - protein, 14 aa, synthetic construct
GSGVHGVSSQNQQT

SEQ ID NO: 448 - protein, 14 aa, synthetic construct
GSSGRDMGGQNQQT

SEQ ID NO: 449 - protein, 14 aa, synthetic construct
GERAFPTSGQNQQT

SEQ ID NO: 450 - protein, 14 aa, synthetic construct
GGRIVSLSGQNQQT

SEQ ID NO: 451 - protein, 14 aa, synthetic construct
GSGQNSYSHTSQQT

SEQ ID NO: 452 - protein, 14 aa, synthetic construct
GLGYPGSSGQNQQT

SEQ ID NO: 453 - protein, 14 aa, synthetic construct
GSGPQSHTGQNQQT

SEQ ID NO: 454 - protein, 14 aa, synthetic construct
GSGQNQQLSRDAST

SEQ ID NO: 455 - protein, 14 aa, synthetic construct
GSGQILHSVPNQQT

SEQ ID NO: 456 - protein, 14 aa, synthetic construct
GSGFHTDSRQNQQT

SEQ ID NO: 457 - protein, 14 aa, synthetic construct
GSGQSHSLATNQQT

SEQ ID NO: 458 - protein, 14 aa, synthetic construct
GSGQNQQTLSKPWT

SEQ ID NO: 459 - protein, 14 aa, synthetic construct
GSGHAAISQQNQQT

SEQ ID NO: 460 - protein, 14 aa, synthetic construct
GSGQNQQQIGGNST

SEQ ID NO: 461 - protein, 14 aa, synthetic construct
GGGPMAGSGQNQQT

SEQ ID NO: 462 - protein, 14 aa, synthetic construct
GMRMEYQSGQNQQT

SEQ ID NO: 463 - protein, 14 aa, synthetic construct
GSGQNQQGTLLHQT

SEQ ID NO: 464 - protein, 14 aa, synthetic construct
GSGQNQRSSGGVQT

SEQ ID NO: 465 - protein, 14 aa, synthetic construct
GSGQNQRGALATQT

SEQ ID NO: 466 - protein, 14 aa, synthetic construct
GSGTVHAATQNQQT

SEQ ID NO: 467 - protein, 14 aa, synthetic construct
GSRMTQQFGQNQQT

SEQ ID NO: 468 - protein, 14 aa, synthetic construct
GSSSPGASGQNQQT

SEQ ID NO: 469 - protein, 14 aa, synthetic construct
GHPSPHVSGQNQQT

SEQ ID NO: 470 - protein, 14 aa, synthetic construct
GSGSHHASRQNQQT

SEQ ID NO: 471 - protein, 14 aa, synthetic construct
GAVGHSYSGQNQQT

SEQ ID NO: 472 - protein, 14 aa, synthetic construct
GSRSQYDIGQNQQT

SEQ ID NO: 473 - protein, 14 aa, synthetic construct
GSGQGPQERGNQQT

SEQ ID NO: 474 - protein, 14 aa, synthetic construct
GSIAHVGTGQNQQT

SEQ ID NO: 475 - protein, 14 aa, synthetic construct
GSGQNQQKQNHGNT

SEQ ID NO: 476 - protein, 14 aa, synthetic construct
GSGQNQQALGSQRT

SEQ ID NO: 477 - protein, 14 aa, synthetic construct
GSGAITHMPQNQQT

SEQ ID NO: 478 - protein, 14 aa, synthetic construct
GSGQRNPLLLNQQT

SEQ ID NO: 479 - protein, 14 aa, synthetic construct
GSSGIPVSHQNQQT

SEQ ID NO: 480 - protein, 14 aa, synthetic construct
GVHSLTPSGQNQQT

SEQ ID NO: 481 - protein, 14 aa, synthetic construct
GVIVLHGSGQNQQT

SEQ ID NO: 482 - protein, 14 aa, synthetic construct
GGTRVVDSGQNQQT

SEQ ID NO: 483 - protein, 14 aa, synthetic construct
GSGGVTYQSQNQQT

SEQ ID NO: 484 - protein, 14 aa, synthetic construct
GSGQNQAGHGPGQT

SEQ ID NO: 485 - protein, 14 aa, synthetic construct
GSGQLVTSGPNQQT

SEQ ID NO: 486 - protein, 14 aa, synthetic construct
GSGIAAQRTQNQQT

SEQ ID NO: 487 - protein, 14 aa, synthetic construct
GSTPAGVGGQNQQT

SEQ ID NO: 488 - protein, 14 aa, synthetic construct
GSGQNQQTSTGVHS

SEQ ID NO: 489 - protein, 14 aa, synthetic construct
GSGQIRQLVDNQQT

SEQ ID NO: 490 - protein, 14 aa, synthetic construct
GSLIGMQSGQNQQT

SEQ ID NO: 491 - protein, 14 aa, synthetic construct
GSGQIKGKMDNQQT

SEQ ID NO: 492 - protein, 14 aa, synthetic construct
GSGSDMSSWQNQQT

SEQ ID NO: 493 - protein, 14 aa, synthetic construct
GRGQNQQHTGLATT

SEQ ID NO: 494 - protein, 14 aa, synthetic construct
GSGQNQQTLYSSNT

SEQ ID NO: 495 - protein, 14 aa, synthetic construct
GSGQTQVLKSNQQT

SEQ ID NO: 496 - protein, 14 aa, synthetic construct
GSRTLSNVGQNQQT

SEQ ID NO: 497 - protein, 14 aa, synthetic construct
GSGVQHSLPQNQQT

SEQ ID NO: 498 - protein, 14 aa, synthetic construct
GNYLHQASGQNQQT

SEQ ID NO: 499 - protein, 14 aa, synthetic construct
GSGGTSVHQQNQQT

SEQ ID NO: 500 - protein, 14 aa, synthetic construct
GMDHSRPSGQNQQT

SEQ ID NO: 501 - protein, 14 aa, synthetic construct
GSGQNQQSMGTFTT

SEQ ID NO: 502 - protein, 14 aa, synthetic construct
GSGQNQQTPLRPPT

SEQ ID NO: 503 - protein, 14 aa, synthetic construct
GSGQNQHHSVSQQT

SEQ ID NO: 504 - protein, 14 aa, synthetic construct
GSGQLRSLSTNQQT

SEQ ID NO: 505 - protein, 14 aa, synthetic construct
GSGSPRQLSQNQQT

SEQ ID NO: 506 - protein, 14 aa, synthetic construct
GSGQNQQTTASSHT

SEQ ID NO: 507 - protein, 14 aa, synthetic construct
GRGQVVSTHQNQQT

SEQ ID NO: 508 - protein, 14 aa, synthetic construct
GSAQVSMVGQNQQT

SEQ ID NO: 509 - protein, 14 aa, synthetic construct
GSSTLVTIGKNQQT

SEQ ID NO: 510 - protein, 14 aa, synthetic construct
GFAHQASSGQNQQT

SEQ ID NO: 511 - protein, 14 aa, synthetic construct
GSGQPVLSISNQQT

SEQ ID NO: 512 - protein, 14 aa, synthetic construct
GSGQSHRSELNQQT

SEQ ID NO: 513 - protein, 14 aa, synthetic construct
GSSVGSPIGQNQQT

SEQ ID NO: 514 - protein, 14 aa, synthetic construct
GSGMPIRNVQNQQT

SEQ ID NO: 515 - protein, 14 aa, synthetic construct
GSSTRVDSGQNQQT

SEQ ID NO: 516 - protein, 14 aa, synthetic construct
GSGQNQQTAMRSTT

SEQ ID NO: 517 - protein, 14 aa, synthetic construct
GSGQNQQHSSSHLT

SEQ ID NO: 518 - protein, 14 aa, synthetic construct
GSRNGHAVGQNQQT

SEQ ID NO: 519 - protein, 14 aa, synthetic construct
GLGAYQSSGQNQQT

SEQ ID NO: 520 - protein, 14 aa, synthetic construct
GPGLSGHSGQNQQT

SEQ ID NO: 521 - protein, 14 aa, synthetic construct
GSTGIVSSGQNQQT

SEQ ID NO: 522 - protein, 14 aa, synthetic construct
GSRTTQVIGQNQQT

SEQ ID NO: 523 - protein, 14 aa, synthetic construct
GSGLLHRAQQNQQT

SEQ ID NO: 524 - protein, 14 aa, synthetic construct
GSGQNAQQAAAQQT

SEQ ID NO: 525 - protein, 14 aa, synthetic construct
GSGQNQQSALRTQT

SEQ ID NO: 526 - protein, 14 aa, synthetic construct
GSGFLSDTRQNQQT

SEQ ID NO: 527 - protein, 14 aa, synthetic construct
GSGLLYHDQQNQQT

SEQ ID NO: 528 - protein, 14 aa, synthetic construct
GSGQNQHYSLHKQT

SEQ ID NO: 529 - protein, 14 aa, synthetic construct
GSGHSPLPQQNQQT

SEQ ID NO: 530 - protein, 14 aa, synthetic construct
GNGHSMRPNQNQQT

SEQ ID NO: 531 - protein, 14 aa, synthetic construct
GSGLKWSTLQNQQT

SEQ ID NO: 532 - protein, 14 aa, synthetic construct
GSGQMGRQAVNQQT

SEQ ID NO: 533 - protein, 14 aa, synthetic construct
GSGQNQQTSGVLTL

SEQ ID NO: 534 - protein, 14 aa, synthetic construct
GSGQNQQALHNPHT

SEQ ID NO: 535 - protein, 14 aa, synthetic construct
GSGQNQQVIPNSKT

SEQ ID NO: 536 - protein, 14 aa, synthetic construct
GSPLQDRVGQNQQT

SEQ ID NO: 537 - protein, 14 aa, synthetic construct
GSGQNQYSSTNPQT

SEQ ID NO: 538 - protein, 14 aa, synthetic construct
GAMTVTISGQNQQT

SEQ ID NO: 539 - protein, 14 aa, synthetic construct
GSGQNQQLQTLIRT

SEQ ID NO: 540 - protein, 14 aa, synthetic construct
GSGLRQTSQQNQQT

SEQ ID NO: 541 - protein, 14 aa, synthetic construct
GSGQNQQTGLRQQT

SEQ ID NO: 542 - protein, 14 aa, synthetic construct
GSGQTRQMKDNQQT

SEQ ID NO: 543 - protein, 14 aa, synthetic construct
GSGQNHGLQSGQQT

SEQ ID NO: 544 - protein, 14 aa, synthetic construct
GSGQSHRQPENQQT

SEQ ID NO: 545 - protein, 14 aa, synthetic construct
GSGQDRHIVQNQQT

SEQ ID NO: 546 - protein, 14 aa, synthetic construct
GSGQNQQLPHSNLT

SEQ ID NO: 547 - protein, 14 aa, synthetic construct
GSGQLSVPYDNQQT

SEQ ID NO: 548 - protein, 14 aa, synthetic construct
GSGRNPQTQPLQQT

SEQ ID NO: 549 - protein, 14 aa, synthetic construct
GSGQPYSTGLNQQT

SEQ ID NO: 550 - protein, 14 aa, synthetic construct
GSGQNQQTHGGLRD

SEQ ID NO: 551 - protein, 14 aa, synthetic construct
GAYGMVSSGQNQQT

SEQ ID NO: 552 - protein, 14 aa, synthetic construct
GSGIQSSYSQNQQT

SEQ ID NO: 553 - protein, 14 aa, synthetic construct
GPRLSDQSGQNQQT

SEQ ID NO: 554 - protein, 14 aa, synthetic construct
GSGQNQQTHPSPCT

SEQ ID NO: 555 - protein, 14 aa, synthetic construct
GSGQSFQMHTNQQT

SEQ ID NO: 556 - protein, 14 aa, synthetic construct
GSGQNQQTGNPKHT

SEQ ID NO: 557 - protein, 14 aa, synthetic construct
GFSSAVHSGQNQQT

SEQ ID NO: 558 - protein, 14 aa, synthetic construct
GSGQNQQTSMSNAT

SEQ ID NO: 559 - protein, 14 aa, synthetic construct
GSGQDMKQHHNQQT

SEQ ID NO: 560 - protein, 14 aa, synthetic construct
GLRLSTPSGQNQQT

SEQ ID NO: 561 - protein, 14 aa, synthetic construct
GSGQNQQTSVYMNT

SEQ ID NO: 562 - protein, 14 aa, synthetic construct
GSGQNQYSQSSMQT

SEQ ID NO: 563 - protein, 14 aa, synthetic construct
GSGQNQQSMADHTT

SEQ ID NO: 564 - protein, 14 aa, synthetic construct
GWERSFVSGQNQQT

SEQ ID NO: 565 - protein, 14 aa, synthetic construct
GLLAGKSSGQNQQT

SEQ ID NO: 566 - protein, 14 aa, synthetic construct
GKSFVPQSGQNQQT

SEQ ID NO: 567 - protein, 14 aa, synthetic construct
GSGQMQSAGSNQQT

SEQ ID NO: 568 - protein, 14 aa, synthetic construct
GSDQNQRLTSSMQT

SEQ ID NO: 569 - protein, 14 aa, synthetic construct
GESRAVLSGQNQQT

SEQ ID NO: 570 - protein, 14 aa, synthetic construct
GSVFGVPSGQNQQT

SEQ ID NO: 571 - protein, 14 aa, synthetic construct
GSGLPDRNLQNQQT

SEQ ID NO: 572 - protein, 14 aa, synthetic construct
GSGTHNSAIQNQQT

SEQ ID NO: 573 - protein, 14 aa, synthetic construct
GSGMIIASMQNQQT

SEQ ID NO: 574 - protein, 14 aa, synthetic construct
GGITWTDSGQNQQT

SEQ ID NO: 575 - protein, 14 aa, synthetic construct
GSGQNQQASGRQQT

SEQ ID NO: 576 - protein, 14 aa, synthetic construct
GSGQNQQPHLKSLT

SEQ ID NO: 577 - protein, 14 aa, synthetic construct
GPPQHMTSGQNQQT

SEQ ID NO: 578 - protein, 14 aa, synthetic construct
GSGQNQQASLPSRT

SEQ ID NO: 579 - protein, 14 aa, synthetic construct
GSGQIVSTQTNQQT

SEQ ID NO: 580 - protein, 14 aa, synthetic construct
GSGKGHSAGQNQQT

SEQ ID NO: 581 - protein, 14 aa, synthetic construct
GSGQNTRLQLGQQT

SEQ ID NO: 582 - protein, 14 aa, synthetic construct
GSVGSRPVGQNQQT

SEQ ID NO: 583 - protein, 14 aa, synthetic construct
GSSHTLALGQNQQT

SEQ ID NO: 584 - protein, 14 aa, synthetic construct
GMYEYSQSGQNQQT

SEQ ID NO: 585 - protein, 14 aa, synthetic construct
GNGQNQQHSILHGT

SEQ ID NO: 586 - protein, 14 aa, synthetic construct
GSGYNQPHLQNQQT

SEQ ID NO: 587 - protein, 14 aa, synthetic construct
GPLVNASSGQNQQT

SEQ ID NO: 588 - protein, 14 aa, synthetic construct
GSGQNQQVLTTART

SEQ ID NO: 589 - protein, 14 aa, synthetic construct
GSGQNQHSVHNDQT

SEQ ID NO: 590 - protein, 14 aa, synthetic construct
GAGLIMHSGQNQQT

SEQ ID NO: 591 - protein, 14 aa, synthetic construct
GMGRHSASGQNQQT

SEQ ID NO: 592 - protein, 14 aa, synthetic construct
GSHSQSGHGQNQQT

SEQ ID NO: 593 - protein, 14 aa, synthetic construct
GSSTTIVSGQNHQT

SEQ ID NO: 594 - protein, 14 aa, synthetic construct
GRHLVTASGQNQQT

SEQ ID NO: 595 - protein, 14 aa, synthetic construct
GSGQNQQHANLNQT

SEQ ID NO: 596 - protein, 14 aa, synthetic construct
GSGSTHSKAQNQQT

SEQ ID NO: 597 - protein, 14 aa, synthetic construct
GSGQNKQMLSGNTT

SEQ ID NO: 598 - protein, 14 aa, synthetic construct
GSGQVHNPTQNQQT

SEQ ID NO: 599 - protein, 14 aa, synthetic construct
GSGQNQQIPHVHQT

SEQ ID NO: 600 - protein, 14 aa, synthetic construct
GSLHAGLSGQNQQT

SEQ ID NO: 601 - protein, 14 aa, synthetic construct
GPAQHGTSGQNQQT

SEQ ID NO: 602 - protein, 14 aa, synthetic construct
GEKAVTSSGQNQQT

SEQ ID NO: 603 - protein, 14 aa, synthetic construct
GSGQNQQTMANGQR

SEQ ID NO: 604 - protein, 14 aa, synthetic construct
GSGSPHSKDQNQQT

SEQ ID NO: 605 - protein, 14 aa, synthetic construct
GSFSMGYGGQNQQT

SEQ ID NO: 606 - protein, 14 aa, synthetic construct
GSGTHLVSLQNQQT

SEQ ID NO: 607 - protein, 14 aa, synthetic construct
GSGQMQPHVQNQQT

SEQ ID NO: 608 - protein, 14 aa, synthetic construct
GSGQNQQVAGLNNT

SEQ ID NO: 609 - protein, 14 aa, synthetic construct
GSSQNQQHDMRLRT

SEQ ID NO: 610 - protein, 14 aa, synthetic construct
GPASLPISGQNQQT

SEQ ID NO: 611 - protein, 14 aa, synthetic construct
GSGQNQQPPLATRT

SEQ ID NO: 612 - protein, 14 aa, synthetic construct
GSSRVPVSGQNQQT

SEQ ID NO: 613 - protein, 14 aa, synthetic construct
GSGQNQQTNLGHTT

SEQ ID NO: 614 - protein, 14 aa, synthetic construct
GSGQNQQLVSRVQT

SEQ ID NO: 615 - protein, 14 aa, synthetic construct
GPNSYPVSGQKQQT

SEQ ID NO: 616 - protein, 14 aa, synthetic construct
GHAHYQASGQNQQT

SEQ ID NO: 617 - protein, 14 aa, synthetic construct
GSGQALLSTGNQQT

SEQ ID NO: 618 - protein, 14 aa, synthetic construct
GSGQLPRQMTNQQT

SEQ ID NO: 619 - protein, 14 aa, synthetic construct
GSGFPKSTEQNQQT

SEQ ID NO: 620 - protein, 14 aa, synthetic construct
GSRETSLSGQNQQT

SEQ ID NO: 621 - protein, 14 aa, synthetic construct
GSGQNQQGTGVSHT

SEQ ID NO: 622 - protein, 14 aa, synthetic construct
GSRTVPVYGQNQQT

SEQ ID NO: 623 - protein, 14 aa, synthetic construct
GSNAQSAHGQNQQT

SEQ ID NO: 624 - protein, 14 aa, synthetic construct
GAFHLAASGQNQQT

SEQ ID NO: 625 - protein, 14 aa, synthetic construct
GSGQYRSSSDNQQT

SEQ ID NO: 626 - protein, 14 aa, synthetic construct
GSGQVYISTPNQQT

SEQ ID NO: 627 - protein, 14 aa, synthetic construct
GSGVSTQLLQNQQT

SEQ ID NO: 628 - protein, 14 aa, synthetic construct
GSGQLGLSVTNQQT

SEQ ID NO: 629 - protein, 14 aa, synthetic construct
GSGSNMRLSQNQQT

SEQ ID NO: 630 - protein, 14 aa, synthetic construct
GSGQNLHSGLPQQT

SEQ ID NO: 631 - protein, 14 aa, synthetic construct
GSSHTLALGQNKQT

SEQ ID NO: 632 - protein, 14 aa, synthetic construct
GSGQNQHSLPAHRT

SEQ ID NO: 633 - protein, 14 aa, synthetic construct
GSGQNQGTVYPNQT

SEQ ID NO: 634 - protein, 14 aa, synthetic construct
GSGQNQQPSLRQST

SEQ ID NO: 635 - protein, 14 aa, synthetic construct
GSGQNARLKDNQQT

SEQ ID NO: 636 - protein, 14 aa, synthetic construct
GHAGSTGSGQNQQT

SEQ ID NO: 637 - protein, 14 aa, synthetic construct
GSGQALSSSGNQQT

SEQ ID NO: 638 - protein, 14 aa, synthetic construct
GSGASESHRQNQQT

SEQ ID NO: 639 - protein, 14 aa, synthetic construct
GVGVITSSGQNQQT

SEQ ID NO: 640 - protein, 14 aa, synthetic construct
GSLYGQSLGQNQQT

SEQ ID NO: 641 - protein, 14 aa, synthetic construct
GSGQMSDVHGNQQT

SEQ ID NO: 642 - protein, 14 aa, synthetic construct
GSGQNQQHSSKATT

SEQ ID NO: 643 - protein, 14 aa, synthetic construct
GSGQNQQTSVSQQT

SEQ ID NO: 644 - protein, 14 aa, synthetic construct
GSGQKMWKLDNQQT

SEQ ID NO: 645 - protein, 14 aa, synthetic construct
GSGQNVSMQVNQQT

SEQ ID NO: 646 - protein, 14 aa, synthetic construct
GSGQNQRATLSNQT

SEQ ID NO: 647 - protein, 14 aa, synthetic construct
GSGQASSKSANQQT

SEQ ID NO: 648 - protein, 14 aa, synthetic construct
GSGKNQTPIPKGQT

SEQ ID NO: 649 - protein, 14 aa, synthetic construct
GSGQNQQTRQEGST

SEQ ID NO: 650 - protein, 14 aa, synthetic construct
GASSLATSGQNQQT

SEQ ID NO: 651 - protein, 14 aa, synthetic construct
GSGQRGSLTENQQT

SEQ ID NO: 652 - protein, 14 aa, synthetic construct
GSEQTRQRGQNQQT

SEQ ID NO: 653 - protein, 14 aa, synthetic construct
GSGQNQQTLTASKE

SEQ ID NO: 654 - protein, 14 aa, synthetic construct
GSGTSGKTGKNQQT

SEQ ID NO: 655 - protein, 14 aa, synthetic construct
GQLVTFTSGQNQQT

SEQ ID NO: 656 - protein, 14 aa, synthetic construct
GSGQNQQSANKILT

SEQ ID NO: 657 - protein, 14 aa, synthetic construct
GSGQNQQHHSSHTT

SEQ ID NO: 658 - protein, 14 aa, synthetic construct
GSGQNQKGMQPNQT

SEQ ID NO: 659 - protein, 14 aa, synthetic construct
GSGQLVSGLYNQQT

SEQ ID NO: 660 - protein, 14 aa, synthetic construct
GSSVGVPSGQNQQT

SEQ ID NO: 661 - protein, 14 aa, synthetic construct
GSGQNQQWDSRRQT

SEQ ID NO: 662 - protein, 14 aa, synthetic construct
GSEQTRQSGQNQQT

SEQ ID NO: 663 - protein, 14 aa, synthetic construct
GSGIGSHIPQNQQT

SEQ ID NO: 664 - protein, 14 aa, synthetic construct
GSGQNQRLHGVDQT

SEQ ID NO: 665 - protein, 14 aa, synthetic construct
GEVSRVLSGQNQQT

SEQ ID NO: 666 - protein, 14 aa, synthetic construct
GSGQNQQKVSPLLT

SEQ ID NO: 667 - protein, 14 aa, synthetic construct
GSGLALERSQNQQT

SEQ ID NO: 668 - protein, 14 aa, synthetic construct
GPDRIGSSGQNQQT

SEQ ID NO: 669 - protein, 14 aa, synthetic construct
GSGQNQDHQNKQQT

SEQ ID NO: 670 - protein, 14 aa, synthetic construct
GSGQNQQTALYNNT

SEQ ID NO: 671 - protein, 14 aa, synthetic construct
GSGAVHLTAQNQQT

SEQ ID NO: 672 - protein, 14 aa, synthetic construct
GSLVSTQSGQNQQT

SEQ ID NO: 673 - protein, 14 aa, synthetic construct
GSGVSARMVQNQQT

SEQ ID NO: 674 - protein, 14 aa, synthetic construct
GSGQTRMPLANQQT

SEQ ID NO: 675 - protein, 14 aa, synthetic construct
GSGISSRNMQNQQT

SEQ ID NO: 676 - protein, 14 aa, synthetic construct
GSGEKVHSGQNQQT

SEQ ID NO: 677 - protein, 14 aa, synthetic construct
GSGQNQQKLSSMST

SEQ ID NO: 678 - protein, 14 aa, synthetic construct
GSGQNQQTGQHMRV

SEQ ID NO: 679 - protein, 14 aa, synthetic construct
GSGMIHTTAQNQQT

SEQ ID NO: 680 - protein, 14 aa, synthetic construct
GSGQNWPALKGQQT

SEQ ID NO: 681 - protein, 14 aa, synthetic construct
GASHMSISGQNQQT

SEQ ID NO: 682 - protein, 14 aa, synthetic construct
GSDQNQQLGYSKQT

SEQ ID NO: 683 - protein, 14 aa, synthetic construct
GIPSIRESGQNQQT

SEQ ID NO: 684 - protein, 14 aa, synthetic construct
GSGIPSVKFQNQQT

SEQ ID NO: 685 - protein, 14 aa, synthetic construct
GSGQNQQTSVSQNV

SEQ ID NO: 686 - protein, 14 aa, synthetic construct
GSGQNQQIGESRMT

SEQ ID NO: 687 - protein, 14 aa, synthetic construct
GSGSSSMSFQNQQT

SEQ ID NO: 688 - protein, 14 aa, synthetic construct
GSGQKQERAVSKQT

SEQ ID NO: 689 - protein, 14 aa, synthetic construct
GCTTRLNSGQNQQT

SEQ ID NO: 690 - protein, 14 aa, synthetic construct
GSGQNQQIISTKIT

SEQ ID NO: 691 - protein, 14 aa, synthetic construct
GSGQNQQKSLNGNT

SEQ ID NO: 692 - protein, 14 aa, synthetic construct
GSGIPAPRLQNQQT

SEQ ID NO: 693 - protein, 14 aa, synthetic construct
GSGQIRESMGNQQT

SEQ ID NO: 694 - protein, 14 aa, synthetic construct
GSGQNSGVHFNQQT

SEQ ID NO: 695 - protein, 14 aa, synthetic construct
GSGQNIGHSLPQQT

SEQ ID NO: 696 - protein, 14 aa, synthetic construct
GSGERSISVQNQQT

SEQ ID NO: 697 - protein, 14 aa, synthetic construct
GSGLKPNVLQNQQT

SEQ ID NO: 698 - protein, 14 aa, synthetic construct
GSGQVAYAQGNQQT

SEQ ID NO: 699 - protein, 14 aa, synthetic construct
GSGQSSYGSGNQQT

SEQ ID NO: 700 - protein, 14 aa, synthetic construct
GSGQNQAMTHGDQT

SEQ ID NO: 701 - protein, 14 aa, synthetic construct
GSGQNQALVSMGQT

SEQ ID NO: 702 - protein, 14 aa, synthetic construct
GSGQNPSFMRGQQT

SEQ ID NO: 703 - protein, 14 aa, synthetic construct
GSGQNQQSHLRTNT

SEQ ID NO: 704 - protein, 14 aa, synthetic construct
GYTRLETSGQNQQT

SEQ ID NO: 705 - protein, 14 aa, synthetic construct
GSGQSYDMRGNQQT

SEQ ID NO: 706 - protein, 14 aa, synthetic construct
GSRTTQDIGQNQQT

SEQ ID NO: 707 - protein, 14 aa, synthetic construct
GSGHPYKAAQNQQT

SEQ ID NO: 708 - protein, 14 aa, synthetic construct
GRLSNAHGGQNQQT

SEQ ID NO: 709 - protein, 14 aa, synthetic construct
GSGQNQRAVLNDQT

SEQ ID NO: 710 - protein, 14 aa, synthetic construct
GGSHTYGGGQNQQT

SEQ ID NO: 711 - protein, 14 aa, synthetic construct
GSSVNSMIGQNQQT

SEQ ID NO: 712 - protein, 14 aa, synthetic construct
GNSSMMGSGQNQQT

SEQ ID NO: 713 - protein, 14 aa, synthetic construct
GNRDRPSSGQNQQT

SEQ ID NO: 714 - protein, 14 aa, synthetic construct
GSGNMHASRQNQQT

SEQ ID NO: 715 - protein, 14 aa, synthetic construct
GFIFPKVSGQNQQT

SEQ ID NO: 716 - protein, 14 aa, synthetic construct
GSGQNQQLKNSTST

SEQ ID NO: 717 - protein, 14 aa, synthetic construct
GSGQNQQSQYMPRT

SEQ ID NO: 718 - protein, 14 aa, synthetic construct
GSGQRMADIGNQQT

SEQ ID NO: 719 - protein, 14 aa, synthetic construct
GSGQNQSHYPSQQT

SEQ ID NO: 720 - protein, 14 aa, synthetic construct
GSDGKMHRGQNQQT

SEQ ID NO: 721 - protein, 14 aa, synthetic construct
GSGSVGFIGQNQQT

SEQ ID NO: 722 - protein, 14 aa, synthetic construct
GLHGMTLSGQNQQT

SEQ ID NO: 723 - protein, 14 aa, synthetic construct
GSDQSKRGDSNQQT

SEQ ID NO: 724 - protein, 14 aa, synthetic construct
GSLFLATGGQNQQT

SEQ ID NO: 725 - protein, 14 aa, synthetic construct
GSGQNQQPSAFSKT

SEQ ID NO: 726 - protein, 14 aa, synthetic construct
GSGQLPQSGLNQQT

SEQ ID NO: 727 - protein, 14 aa, synthetic construct
GSGSKQNALQNQQT

SEQ ID NO: 728 - protein, 14 aa, synthetic construct
GSGQRRELSQNQQT

SEQ ID NO: 729 - protein, 14 aa, synthetic construct
GSGQREPKASNQQT

SEQ ID NO: 730 - protein, 14 aa, synthetic construct
GSGQNQQHPSTQQT

SEQ ID NO: 731 - protein, 14 aa, synthetic construct
GSQSTLGLGQNQQT

SEQ ID NO: 732 - protein, 14 aa, synthetic construct
GSGQNQQMPGLSST

SEQ ID NO: 733 - protein, 14 aa, synthetic construct
GSGQNQQTVGGKNL

SEQ ID NO: 734 - protein, 14 aa, synthetic construct
GSSREFHSGQNQQT

SEQ ID NO: 735 - protein, 14 aa, synthetic construct
GSGQNQQTVPSNLV

SEQ ID NO: 736 - protein, 14 aa, synthetic construct
GSGQNAYSSQAQQT

SEQ ID NO: 737 - protein, 14 aa, synthetic construct
GSGQNKDHSTRRQT

SEQ ID NO: 738 - protein, 14 aa, synthetic construct
GQLGSVGSGQDQQT

SEQ ID NO: 739 - protein, 14 aa, synthetic construct
GSGQHAAPGHNQQT

SEQ ID NO: 740 - protein, 14 aa, synthetic construct
GSGQNQQTSQSPPT

SEQ ID NO: 741 - protein, 14 aa, synthetic construct
GSGNYRDHEQNQQT

SEQ ID NO: 742 - protein, 14 aa, synthetic construct
GSGQHSNQHVNQQT

SEQ ID NO: 743 - protein, 14 aa, synthetic construct
GSGQTARNGINQQT

SEQ ID NO: 744 - protein, 14 aa, synthetic construct
GSGQNQQHYGSQGT

SEQ ID NO: 745 - protein, 14 aa, synthetic construct
GSGSPQASRQNQQT

SEQ ID NO: 746 - protein, 14 aa, synthetic construct
GSGFSHSMGKNQQT

SEQ ID NO: 747 - protein, 14 aa, synthetic construct
GSGQSHSLETNQQT

SEQ ID NO: 748 - protein, 14 aa, synthetic construct
GTEQTRQSGQNQQT

SEQ ID NO: 749 - protein, 14 aa, synthetic construct
GSGRHLASVQNQQT

SEQ ID NO: 750 - protein, 14 aa, synthetic construct
GLGSKNHSGQNQQT

SEQ ID NO: 751 - protein, 14 aa, synthetic construct
GSGQNQQTSHFPSA

SEQ ID NO: 752 - protein, 14 aa, synthetic construct
GSGQLSGTPQNQQT

SEQ ID NO: 753 - protein, 14 aa, synthetic construct
GSGQNQQAPHKKET

SEQ ID NO: 754 - protein, 14 aa, synthetic construct
GSGQNQQTLRGSLE

SEQ ID NO: 755 - protein, 14 aa, synthetic construct
GSIAMTSHGQNQQT

SEQ ID NO: 756 - protein, 14 aa, synthetic construct
GSPGVSPSGQNQQT

SEQ ID NO: 757 - protein, 14 aa, synthetic construct
GSGQNQQTGSSSRV

SEQ ID NO: 758 - protein, 14 aa, synthetic construct
GSGQHLPLLGNQQT

SEQ ID NO: 759 - protein, 14 aa, synthetic construct
GSDHSHRGGQNQQT

SEQ ID NO: 760 - protein, 14 aa, synthetic construct
GSGIVTKLGQNQQT

SEQ ID NO: 761 - protein, 14 aa, synthetic construct
GSGQDVTKTGNQQT

SEQ ID NO: 762 - protein, 14 aa, synthetic construct
GSGQNQQSHGRIGT

SEQ ID NO: 763 - protein, 14 aa, synthetic construct
GSGQNQQINHRSPT

SEQ ID NO: 764 - protein, 14 aa, synthetic construct
GSGDDSRVGQNQQT

SEQ ID NO: 765 - protein, 14 aa, synthetic construct
GSGQSTLKRINQQT

SEQ ID NO: 766 - protein, 14 aa, synthetic construct
GSGSQHSKAQNQQT

SEQ ID NO: 767 - protein, 14 aa, synthetic construct
GSGQNQQHASSNNT

SEQ ID NO: 768 - protein, 14 aa, synthetic construct
GSRTYQVSGQNQQT

SEQ ID NO: 769 - protein, 14 aa, synthetic construct
GSGQNQGLLSSPQT

SEQ ID NO: 770 - protein, 14 aa, synthetic construct
GSGGGLQHNQNQQT

SEQ ID NO: 771 - protein, 14 aa, synthetic construct
GSGQNQQTTAATRM

SEQ ID NO: 772 - protein, 14 aa, synthetic construct
GSGQNQRASILVQT

SEQ ID NO: 773 - protein, 14 aa, synthetic construct
GSGQNLGLLGAQQT

SEQ ID NO: 774 - protein, 14 aa, synthetic construct
GSLDLGRSGQNQQT

SEQ ID NO: 775 - protein, 14 aa, synthetic construct
GNSQVKVSGQNQQT

SEQ ID NO: 776 - protein, 14 aa, synthetic construct
GSSGSHQYGQNQQT

SEQ ID NO: 777 - protein, 14 aa, synthetic construct
GSGQNQQQRDGTLT

SEQ ID NO: 778 - protein, 14 aa, synthetic construct
GRGQHVSVANNQQT

SEQ ID NO: 779 - protein, 14 aa, synthetic construct
GDSSSRISGQNQQT

SEQ ID NO: 780 - protein, 14 aa, synthetic construct
GSGQNQQHSLSSQT

SEQ ID NO: 781 - protein, 14 aa, synthetic construct
GSLMDVHRGQNQQT

SEQ ID NO: 782 - protein, 14 aa, synthetic construct
GSIQYQSSGQNQQT

SEQ ID NO: 783 - protein, 14 aa, synthetic construct
GLGSKNPSGQNQQT

SEQ ID NO: 784 - protein, 14 aa, synthetic construct
GSGQLVLTLQNQQT

SEQ ID NO: 785 - protein, 14 aa, synthetic construct
GSGQNQQTSQPLPG

SEQ ID NO: 786 - protein, 14 aa, synthetic construct
GSGQNQQNLGKLNT

SEQ ID NO: 787 - protein, 14 aa, synthetic construct
GTTAHQPSGQNQQT

SEQ ID NO: 788 - protein, 14 aa, synthetic construct
GSGQNRAQIGTQQT

SEQ ID NO: 789 - protein, 14 aa, synthetic construct
GSGQYVHVSSNQQT

SEQ ID NO: 790 - protein, 14 aa, synthetic construct
GSGQNQQTAHAFNI

SEQ ID NO: 791 - protein, 14 aa, synthetic construct
GSGQNQRTMVATQT

SEQ ID NO: 792 - protein, 14 aa, synthetic construct
GSGQNPIRGAMQQT

SEQ ID NO: 793 - protein, 14 aa, synthetic construct
GSGYVITGSQNQQT

SEQ ID NO: 794 - protein, 14 aa, synthetic construct
GRGPKQSNIQNQQT

SEQ ID NO: 795 - protein, 14 aa, synthetic construct
GSGQNQQTMLGKPC

SEQ ID NO: 796 - protein, 14 aa, synthetic construct
GSGQNQQVGSTVRT

SEQ ID NO: 797 - protein, 14 aa, synthetic construct
GNVTTQKSGQNQQT

SEQ ID NO: 798 - protein, 14 aa, synthetic construct
GSGNPVSHLQNQQT

SEQ ID NO: 799 - protein, 14 aa, synthetic construct
GSLSHMESGQNQQT

SEQ ID NO: 800 - protein, 14 aa, synthetic construct
GRAPTNLSGQNQQT

SEQ ID NO: 801 - protein, 14 aa, synthetic construct
GSGQNQQTVMTARA

SEQ ID NO: 802 - protein, 14 aa, synthetic construct
GSGMPASRLQNQQT

SEQ ID NO: 803 - protein, 14 aa, synthetic construct
GVVRNHQSGQNQQT

SEQ ID NO: 804 - protein, 14 aa, synthetic construct
GSGQNQHSVQVRQT

SEQ ID NO: 805 - protein, 14 aa, synthetic construct
GSGQNTGHLTMQQT

SEQ ID NO: 806 - protein, 14 aa, synthetic construct
GSGQNQQYAGKILT

SEQ ID NO: 807 - protein, 14 aa, synthetic construct
GSGNPHVRNQNQQT

SEQ ID NO: 808 - protein, 14 aa, synthetic construct
GSGQNGGSSNRQQT

SEQ ID NO: 809 - protein, 14 aa, synthetic construct
GSGQRLSQGVNHQT

SEQ ID NO: 810 - protein, 14 aa, synthetic construct
GSGQNAHAKEGQQT

SEQ ID NO: 811 - protein, 14 aa, synthetic construct
GSSPAPNSGQNQQT

SEQ ID NO: 812 - protein, 14 aa, synthetic construct
GLAHKTSSGQNQQT

SEQ ID NO: 813 - protein, 14 aa, synthetic construct
GSGQNQQTPGAHKT

SEQ ID NO: 814 - protein, 14 aa, synthetic construct
GSGQNQQSLSGSFT

SEQ ID NO: 815 - protein, 14 aa, synthetic construct
GSGQNQQSTGTSRT

SEQ ID NO: 816 - protein, 14 aa, synthetic construct
GSGQNQQTVQSNLV

SEQ ID NO: 817 - protein, 14 aa, synthetic construct
GSGQNQQLGSRQCT

SEQ ID NO: 818 - protein, 14 aa, synthetic construct
GSGQNQYLRLELQT

SEQ ID NO: 819 - protein, 14 aa, synthetic construct
GSGQNQQTSPRLQT

SEQ ID NO: 820 - protein, 14 aa, synthetic construct
GSGQNQQTTSSNMT

SEQ ID NO: 821 - protein, 14 aa, synthetic construct
GTASTYNSGQNQQT

SEQ ID NO: 822 - protein, 14 aa, synthetic construct
GSGQNQQTMPQHKI

SEQ ID NO: 823 - protein, 14 aa, synthetic construct
GSGQSHLHTGNQQT

SEQ ID NO: 824 - protein, 14 aa, synthetic construct
GVKGVGHSGQNQQT

SEQ ID NO: 825 - protein, 14 aa, synthetic construct
GSGKVTKQSQNQQT

SEQ ID NO: 826 - protein, 14 aa, synthetic construct
GSGQNQQTALEKSL

SEQ ID NO: 827 - protein, 14 aa, synthetic construct
GSGYKDTYGQNQQT

SEQ ID NO: 828 - protein, 14 aa, synthetic construct
GSGQNQQSGTFLST

SEQ ID NO: 829 - protein, 14 aa, synthetic construct
GSGQNTGQHMMQQT

SEQ ID NO: 830 - protein, 14 aa, synthetic construct
GSGKNQQRPGLDQT

SEQ ID NO: 831 - protein, 14 aa, synthetic construct
GSGQSREISLNQQT

SEQ ID NO: 832 - protein, 14 aa, synthetic construct
GTPTSPSSGQNQQT

SEQ ID NO: 833 - protein, 14 aa, synthetic construct
GKPAGGLSGQNQQT

SEQ ID NO: 834 - protein, 14 aa, synthetic construct
GSGQNHRSADMQQT

SEQ ID NO: 835 - protein, 14 aa, synthetic construct
GSGQNQQTLPSLSL

SEQ ID NO: 836 - protein, 14 aa, synthetic construct
GSPYMGATGQNQQT

SEQ ID NO: 837 - protein, 14 aa, synthetic construct
GSGHAKAVGQNQQT

SEQ ID NO: 838 - protein, 14 aa, synthetic construct
GHMKGVTSGQNQQT

SEQ ID NO: 839 - protein, 14 aa, synthetic construct
GSGQNQKILTLDQT

SEQ ID NO: 840 - protein, 14 aa, synthetic construct
GSGQNQQTKVGHSA

SEQ ID NO: 841 - protein, 14 aa, synthetic construct
GIARTTISGQNQQT

SEQ ID NO: 842 - protein, 14 aa, synthetic construct
GSGQNQQTSVGFRT

SEQ ID NO: 843 - protein, 14 aa, synthetic construct
GSGQNQQTMIANIR

SEQ ID NO: 844 - protein, 14 aa, synthetic construct
GDMTRSSSGQNQQT

SEQ ID NO: 845 - protein, 14 aa, synthetic construct
GSGHMSDLRQNQQT

SEQ ID NO: 846 - protein, 14 aa, synthetic construct
GRGAVMASGQNQQT

SEQ ID NO: 847 - protein, 14 aa, synthetic construct
GSGQNQQLSGKSVT

SEQ ID NO: 848 - protein, 14 aa, synthetic construct
GSHTLVVSGQNQQT

SEQ ID NO: 849 - protein, 14 aa, synthetic construct
GSGPWSAGLQNQQT

SEQ ID NO: 850 - protein, 14 aa, synthetic construct
GSGQHSPHALNQQT

SEQ ID NO: 851 - protein, 14 aa, synthetic construct
GSGQNQQPNSGSMT

SEQ ID NO: 852 - protein, 14 aa, synthetic construct
GSGLAHLGGQNQQT

SEQ ID NO: 853 - protein, 14 aa, synthetic construct
GSSVRYEPKQNQQT

SEQ ID NO: 854 - protein, 14 aa, synthetic construct
GSGQNQQARPLELT

SEQ ID NO: 855 - protein, 14 aa, synthetic construct
GSGQPRSTGINQQT

SEQ ID NO: 856 - protein, 14 aa, synthetic construct
GSGQNQANWVKVQT

SEQ ID NO: 857 - protein, 14 aa, synthetic construct
GSGHLFQSGQNQQT

SEQ ID NO: 858 - protein, 14 aa, synthetic construct
GSGQNRGISISQQT

SEQ ID NO: 859 - protein, 14 aa, synthetic construct
GSGTHYDNRQNQQT

SEQ ID NO: 860 - protein, 14 aa, synthetic construct
GSGQNQQTSTTPLP

SEQ ID NO: 861 - protein, 14 aa, synthetic construct
GSGQVHASQVNQKT

SEQ ID NO: 862 - protein, 14 aa, synthetic construct
GSSGHRESGQNQQT

SEQ ID NO: 863 - protein, 14 aa, synthetic construct
GLSAEKSSGQNQQT

SEQ ID NO: 864 - protein, 14 aa, synthetic construct
GSGQEHRSLANQQT

SEQ ID NO: 865 - protein, 14 aa, synthetic construct
GSGQTVVRIANQQT

SEQ ID NO: 866 - protein, 14 aa, synthetic construct
GSGQNVSSVHRQQT

SEQ ID NO: 867 - protein, 14 aa, synthetic construct
GSGASRMSIQNQQT

SEQ ID NO: 868 - protein, 14 aa, synthetic construct
GVAFIGSSGQNQQT

SEQ ID NO: 869 - protein, 14 aa, synthetic construct
GSGQNQQTVPTRQT

SEQ ID NO: 870 - protein, 14 aa, synthetic construct
GSGQAAKSSQNQQT

SEQ ID NO: 871 - protein, 14 aa, synthetic construct
GSGQNQQVAIRTST

SEQ ID NO: 872 - protein, 14 aa, synthetic construct
GSVHMQNAGQNQQT

SEQ ID NO: 873 - protein, 14 aa, synthetic construct
GSGMRQAGVQNQQT

SEQ ID NO: 874 - protein, 14 aa, synthetic construct
GSGQNQQVGGKTVT

SEQ ID NO: 875 - protein, 14 aa, synthetic construct
GVHDMRVSGQNQQT

SEQ ID NO: 876 - protein, 14 aa, synthetic construct
GSGQHVSVANNQQT

SEQ ID NO: 877 - protein, 14 aa, synthetic construct
GSAAMSVRGQNQQT

SEQ ID NO: 878 - protein, 14 aa, synthetic construct
GVSRGGPSGQNQQT

SEQ ID NO: 879 - protein, 14 aa, synthetic construct
GSGQMVHTIGNQQT

SEQ ID NO: 880 - protein, 14 aa, synthetic construct
GRGGSMAETQNQQT

SEQ ID NO: 881 - protein, 14 aa, synthetic construct
GSGHTNPTRQNQQT

SEQ ID NO: 882 - protein, 14 aa, synthetic construct
GSGEAARYEQNQQT

SEQ ID NO: 883 - protein, 14 aa, synthetic construct
GSGQNERHLVLQQT

SEQ ID NO: 884 - protein, 14 aa, synthetic construct
GSGQNQQSKQQVLT

SEQ ID NO: 885 - protein, 14 aa, synthetic construct
GSGQARAHRGNQQT

SEQ ID NO: 886 - protein, 14 aa, synthetic construct
GSGQNQQPLDTSRT

SEQ ID NO: 887 - protein, 14 aa, synthetic construct
GSGQNQQLANMVTT

SEQ ID NO: 888 - protein, 14 aa, synthetic construct
GSGQMKDLHRNQQT

SEQ ID NO: 889 - protein, 14 aa, synthetic construct
GSGQNQHLSSFVQT

SEQ ID NO: 890 - protein, 14 aa, synthetic construct
GSGQNQQPSSRVTT

SEQ ID NO: 891 - protein, 14 aa, synthetic construct
GSGQNQQLAITLGT

SEQ ID NO: 892 - protein, 14 aa, synthetic construct
GSGQNQQTVGNPAT

SEQ ID NO: 893 - protein, 14 aa, synthetic construct
GSGQNQGRAHPMQT

SEQ ID NO: 894 - protein, 14 aa, synthetic construct
GSGQLIASVVNQQT

SEQ ID NO: 895 - protein, 14 aa, synthetic construct
GSSVRSLVGQNQQT

SEQ ID NO: 896 - protein, 14 aa, synthetic construct
GGAGSAHSGQNQQT

SEQ ID NO: 897 - protein, 14 aa, synthetic construct
GSDQNQQTMSSTRT

SEQ ID NO: 898 - protein, 14 aa, synthetic construct
GSGQNQQMAGAFRT

SEQ ID NO: 899 - protein, 14 aa, synthetic construct
GSLGNLQRGQNQQT

SEQ ID NO: 900 - protein, 14 aa, synthetic construct
GSGPSISHGQNQQT

SEQ ID NO: 901 - protein, 14 aa, synthetic construct
GSGQNQQSSFNVQT

SEQ ID NO: 902 - protein, 14 aa, synthetic construct
GSGQNQQTGQATHN

SEQ ID NO: 903 - protein, 14 aa, synthetic construct
VSGSPHSKAQNQQT

SEQ ID NO: 904 - protein, 14 aa, synthetic construct
CSGSPHSKAQNQQT

SEQ ID NO: 905 - protein, 14 aa, synthetic construct
GSGSPHRKAQNQQT

SEQ ID NO: 906 - protein, 14 aa, synthetic construct
GRGSPHSKAQNQQT

SEQ ID NO: 907 - protein, 14 aa, synthetic construct
GSGSPHSKAQNKQT

SEQ ID NO: 908 - protein, 14 aa, synthetic construct
GSGSPHSKAQTQQT

SEQ ID NO: 909 - protein, 14 aa, synthetic construct
GSGSTHASRQNQQT

SEQ ID NO: 910 - protein, 14 aa, synthetic construct
GSGSPHKYGQNQQT

SEQ ID NO: 911 - protein, 14 aa, synthetic construct
GSGSPHKFGQNQQT

SEQ ID NO: 912 - protein, 14 aa, synthetic construct
VSGSPHKFGQNQQT

SEQ ID NO: 913 - protein, 14 aa, synthetic construct
GSGSPHSKAQNHQT

SEQ ID NO: 914 - protein, 14 aa, synthetic construct
GSGSPHSKAQHQQT

SEQ ID NO: 915 - protein, 14 aa, synthetic construct
GSGSPHKTYQNQQT

SEQ ID NO: 916 - protein, 14 aa, synthetic construct
VSGSPHASRQNQQT

SEQ ID NO: 917 - protein, 14 aa, synthetic construct
GSGSPHKFGKNQQT

SEQ ID NO: 918 - protein, 14 aa, synthetic construct
GSGSPHASRQNQHT

SEQ ID NO: 919 - protein, 14 aa, synthetic construct
GSHSPHKSGQNQQT

SEQ ID NO: 920 - protein, 14 aa, synthetic construct
GSGQNQQRRMSPST

SEQ ID NO: 921 - protein, 14 aa, synthetic construct
GSGSPHSKPQNQQT

SEQ ID NO: 922 - protein, 14 aa, synthetic construct
GSGSPHKFGQKQQT

SEQ ID NO: 923 - protein, 14 aa, synthetic construct
VSGSPHGARQNQQT

SEQ ID NO: 924 - protein, 14 aa, synthetic construct
GSGSPHSKAQKQQT

SEQ ID NO: 925 - protein, 14 aa, synthetic construct
GSHSPHKRGQNQQT

SEQ ID NO: 926 - protein, 14 aa, synthetic construct
GSGQNRQRLKGLET

SEQ ID NO: 927 - protein, 14 aa, synthetic construct
GSGSPHKLGQNQQT

SEQ ID NO: 928 - protein, 14 aa, synthetic construct
GSGSPHKTSKNQQT

SEQ ID NO: 929 - protein, 14 aa, synthetic construct
GSGSPHKIGQNQQT

SEQ ID NO: 930 - protein, 14 aa, synthetic construct
GSGQDSPHVRNQQT

SEQ ID NO: 931 - protein, 14 aa, synthetic construct
GSGSPHKTSQNQQT

SEQ ID NO: 932 - protein, 14 aa, synthetic construct
GSGSPHASRKNQQT

SEQ ID NO: 933 - protein, 14 aa, synthetic construct
GSHSPHKSGQKQQT

SEQ ID NO: 934 - protein, 14 aa, synthetic construct
GSGSPHKTSQKQQT

SEQ ID NO: 935 - protein, 14 aa, synthetic construct
GSGSPHVRGQNKQT

SEQ ID NO: 936 - protein, 14 aa, synthetic construct
GSGSPHKTTQNQQT

SEQ ID NO: 937 - protein, 14 aa, synthetic construct
GSGPVRALRQNQQT

SEQ ID NO: 938 - protein, 14 aa, synthetic construct
GSGSPHVRGQKQQT

SEQ ID NO: 939 - protein, 14 aa, synthetic construct
CSGSPHKTSQNQQT

SEQ ID NO: 940 - protein, 14 aa, synthetic construct
CSHSPHKSGQNQQT

SEQ ID NO: 941 - protein, 6 aa, synthetic construct
SPHSKA

SEQ ID NO: 942 - DNA, 18 bp, synthetic construct
  source 1..18: mol_type = other DNA
agcccacacagcaaagca

SEQ ID NO: 943 - protein, 8 aa, synthetic construct
HDSPHKSG

SEQ ID NO: 944 - DNA, 24 bp, synthetic construct
  source 1..24: mol_type = other DNA
cacgacagcccacacaaaagcgga

SEQ ID NO: 945 - protein, 6 aa, synthetic construct
SPHSKA

SEQ ID NO: 946 - protein, 6 aa, synthetic construct
SPHKSG

SEQ ID NO: 947 - protein, 6 aa, synthetic construct
SPHARM

SEQ ID NO: 948 - protein, 6 aa, synthetic construct
SPHVKS

SEQ ID NO: 949 - protein, 6 aa, synthetic construct
SPHASR

SEQ ID NO: 950 - protein, 6 aa, synthetic construct
SPHVKI

SEQ ID NO: 951 - protein, 6 aa, synthetic construct
SPHKSR

SEQ ID NO: 952 - protein, 6 aa, synthetic construct
SPHSLR

SEQ ID NO: 953 - protein, 6 aa, synthetic construct
SPHSKW

SEQ ID NO: 954 - protein, 6 aa, synthetic construct
SPHKKN

SEQ ID NO: 955 - protein, 6 aa, synthetic construct
SPHVRM

SEQ ID NO: 956 - protein, 6 aa, synthetic construct
SPHRKA

SEQ ID NO: 957 - protein, 6 aa, synthetic construct
SPHKFG

SEQ ID NO: 958 - protein, 6 aa, synthetic construct
SPHKIG

SEQ ID NO: 959 - protein, 6 aa, synthetic construct
SPHKLG

SEQ ID NO: 960 - protein, 6 aa, synthetic construct
SPHSKL

SEQ ID NO: 961 - protein, 6 aa, synthetic construct
SPHSRG

SEQ ID NO: 962 - protein, 6 aa, synthetic construct
SPHSKS

SEQ ID NO: 963 - protein, 6 aa, synthetic construct
SPHKTS

SEQ ID NO: 964 - protein, 6 aa, synthetic construct
SPHKTT

SEQ ID NO: 965 - protein, 6 aa, synthetic construct
SPHKTY

SEQ ID NO: 966 - protein, 6 aa, synthetic construct
SPHKYG

SEQ ID NO: 967 - protein, 6 aa, synthetic construct
SPHSKD

SEQ ID NO: 968 - protein, 6 aa, synthetic construct
SPHSKP

SEQ ID NO: 969 - protein, 6 aa, synthetic construct
SPHSRA

SEQ ID NO: 970 - protein, 6 aa, synthetic construct
SPHSSR

SEQ ID NO: 971 - protein, 6 aa, synthetic construct
SPHWKA

SEQ ID NO: 972 - protein, 6 aa, synthetic construct
SPHTRG

SEQ ID NO: 973 - protein, 6 aa, synthetic construct
SPHVRG

SEQ ID NO: 974 - protein, 6 aa, synthetic construct
SPHKRG

SEQ ID NO: 975 - protein, 6 aa, synthetic construct
SPHGAR

SEQ ID NO: 976 - protein, 6 aa, synthetic construct
SPHRSG

SEQ ID NO: 977 - protein, 6 aa, synthetic construct
SPHKSA

SEQ ID NO: 978 - protein, 6 aa, synthetic construct
SPHSKR

SEQ ID NO: 979 - protein, 6 aa, synthetic construct
SPHFLR

SEQ ID NO: 980 - protein, 6 aa, synthetic construct
SPHVRR

SEQ ID NO: 981 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGSPHSKAQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 982 - protein, 742 aa, synthetic construct
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGHDSPHKSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 983 - DNA, 2229 bp, synthetic construct
  source 1..2229: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtattacttgagtaaaacaattaacggaagcggaagcccacacagcaaagcacaaaaccaacagaccttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaacttataa

SEQ ID NO: 984 - DNA, 2229 bp, synthetic construct
  source 1..2229: mol_type = other DNA
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtattacttgagtaaaacaattaacggacacgacagcccacacaaaagcggacaaaaccaacagaccttgaagttttcggtagctggtcctagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcacgcggtatttaacgaggaacttataa

SEQ ID NO: 985 - protein, 6 aa, synthetic construct
STHASR

SEQ ID NO: 986 - protein, 6 aa, synthetic construct
SQHKSG

SEQ ID NO: 987 - DNA, 1184 bp, synthetic construct
  source 1..1184: mol_type = other DNA
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 988 - DNA, 227 bp, synthetic construct
  source 1..227: mol_type = other DNA
gcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacgcgtaag

SEQ ID NO: 989 - skipped

SEQ ID NO: 990 - DNA, 16 bp, synthetic construct
  source 1..16: mol_type = other DNA
ggtggagaagagcatg

SEQ ID NO: 991 - DNA, 27 bp, synthetic construct
  source 1..27: mol_type = other DNA
gtcatcactgaggtggagaagagcatg

SEQ ID NO: 992-994 - skipped (3 entries)

SEQ ID NO: 995 - DNA, 222 bp, synthetic construct
  source 1..222: mol_type = other DNA
gcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacag

SEQ ID NO: 996 - DNA, 222 bp, synthetic construct
  source 1..222: mol_type = other DNA
gcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacgc

SEQ ID NO: 997 - skipped

SEQ ID NO: 998 - DNA, 229 bp, synthetic construct
  source 1..229: mol_type = other DNA
gtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacgcgtaag

SEQ ID NO: 999 - DNA, 235 bp, synthetic construct
  source 1..235: mol_type = other DNA
gctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacgcgtaag

SEQ ID NO: 1000 - DNA, 241 bp, synthetic construct
  source 1..241: mol_type = other DNA
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacgcgtaag

SEQ ID NO: 1001 - DNA, 236 bp, synthetic construct
  source 1..236: mol_type = other DNA
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacag

SEQ ID NO: 1002 - DNA, 246 bp, synthetic construct
  source 1..246: mol_type = other DNA
gcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacgcgtaag

SEQ ID NO: 1003 - DNA, 241 bp, synthetic construct
  source 1..241: mol_type = other DNA
gcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacag

SEQ ID NO: 1004 - DNA, 257 bp, synthetic construct
  source 1..257: mol_type = other DNA
ggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacgcgtaag

SEQ ID NO: 1005 - DNA, 252 bp, synthetic construct
  source 1..252: mol_type = other DNA
ggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacag

SEQ ID NO: 1006 - DNA, 268 bp, synthetic construct
  source 1..268: mol_type = other DNA
gtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacgcgtaag

SEQ ID NO: 1007 - DNA, 263 bp, synthetic construct
  source 1..263: mol_type = other DNA
gtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacag

SEQ ID NO: 1008 - protein, 18 aa, synthetic construct
KTINGSGSPHSLLWNQQT

SEQ ID NO: 1009 - protein, 18 aa, synthetic construct
KTINGSGSPHSKAQYYVT

SEQ ID NO: 1010 - protein, 18 aa, synthetic construct
KTINGSGSPHSKLRRQQT

SEQ ID NO: 1011 - protein, 18 aa, synthetic construct
KTINGSGSPHSIWQNQQT

SEQ ID NO: 1012 - protein, 18 aa, synthetic construct
KTINGSSSPHCTAQNQQT

SEQ ID NO: 1013 - protein, 18 aa, synthetic construct
KTINGSGSPHSKAGCGQT

SEQ ID NO: 1014 - protein, 18 aa, synthetic construct
KSMNGSGSPHSRAQNQQT

SEQ ID NO: 1015 - protein, 18 aa, synthetic construct
KTINGSGSPHSKRLRQQT

SEQ ID NO: 1016 - protein, 18 aa, synthetic construct
KTINGSGSPHSLRRNQQT

SEQ ID NO: 1017 - protein, 18 aa, synthetic construct
KTINGSGSPHSRGRNQQT

SEQ ID NO: 1018 - protein, 18 aa, synthetic construct
KTINGSGSPHSEIVNQQT

SEQ ID NO: 1019 - protein, 18 aa, synthetic construct
KTINGSGSPHSSRRNQQT

SEQ ID NO: 1020 - protein, 18 aa, synthetic construct
KTINGSGSPHCLLQNQQT

SEQ ID NO: 1021 - protein, 18 aa, synthetic construct
KTIMRVGSPHSKAQNQQT

SEQ ID NO: 1022 - protein, 18 aa, synthetic construct
KTINGSGSPHSKAFRLQT

SEQ ID NO: 1023 - protein, 18 aa, synthetic construct
KTINGSGSPHCLAQNQQT

SEQ ID NO: 1024 - protein, 18 aa, synthetic construct
KTINGSCSPHRKAQNQQT

SEQ ID NO: 1025 - protein, 18 aa, synthetic construct
KTINGSGSPHFLRQNQQT

SEQ ID NO: 1026 - protein, 18 aa, synthetic construct
KTINGSGSPHSLRFNQQT

SEQ ID NO: 1027 - protein, 18 aa, synthetic construct
KTINGSGSPHSYLRNQQT

SEQ ID NO: 1028 - protein, 18 aa, synthetic construct
KTINGSGSPHCSLQNQQT

SEQ ID NO: 1029 - protein, 18 aa, synthetic construct
KTINGSGSPHVLWQNQQT

SEQ ID NO: 1030 - protein, 18 aa, synthetic construct
KTINGSGSPHSKWLLQQT

SEQ ID NO: 1031 - protein, 18 aa, synthetic construct
KTINGSGSPHSLWSNQQT

SEQ ID NO: 1032 - protein, 18 aa, synthetic construct
KTINGSGSPHSKRRLQQT

SEQ ID NO: 1033 - protein, 18 aa, synthetic construct
KTINGSGSPHSVYLNQQT

SEQ ID NO: 1034 - protein, 18 aa, synthetic construct
KTINGSGSPHSLWLNQQT

SEQ ID NO: 1035 - protein, 18 aa, synthetic construct
KTINGSGSPHSKAQRKLT

SEQ ID NO: 1036 - protein, 18 aa, synthetic construct
KTINGSGSPHSKALRRQT

SEQ ID NO: 1037 - protein, 18 aa, synthetic construct
KTINGSGSPHSKAQRLRT

SEQ ID NO: 1038 - protein, 18 aa, synthetic construct
KYLSGSGSPHSKAQNQQT

SEQ ID NO: 1039 - protein, 18 aa, synthetic construct
KTINGSGSPHSKAQRRLT

SEQ ID NO: 1040 - protein, 18 aa, synthetic construct
KTINGSGSPHSKARRQQT

SEQ ID NO: 1041 - protein, 18 aa, synthetic construct
KTINGSGSPHSKARRLQT

SEQ ID NO: 1042 - protein, 18 aa, synthetic construct
KTINGSGSPHSKSRRQQT

SEQ ID NO: 1043 - protein, 18 aa, synthetic construct
KTINGLLSPHWKAQNQQT

SEQ ID NO: 1044 - protein, 18 aa, synthetic construct
KTINGSGSPHSKARLRQT

SEQ ID NO: 1045 - protein, 18 aa, synthetic construct
KTINGSGSPHSKASKRQT

SEQ ID NO: 1046 - protein, 18 aa, synthetic construct
KTINGSGSPHVRRQNQQT

SEQ ID NO: 1047 - protein, 18 aa, synthetic construct
KTINGSGSPHSKAQLYRT

SEQ ID NO: 1048 - protein, 18 aa, synthetic construct
KGLSGSGSPHSKAQNQQT

SEQ ID NO: 1049 - protein, 18 aa, synthetic construct
KTINGSGSPHSLFRNQQT

SEQ ID NO: 1050 - protein, 18 aa, synthetic construct
KTINGSGSPHSKAQLTVT

SEQ ID NO: 1051 - protein, 18 aa, synthetic construct
KTINGSRSPHTRAQNQQT

SEQ ID NO: 1052 - protein, 18 aa, synthetic construct
KTINGSGSPHSKAKLRQT

SEQ ID NO: 1053 - protein, 18 aa, synthetic construct
KTINGSGSPHSKLIRQQT

SEQ ID NO: 1054 - protein, 18 aa, synthetic construct
KTINGSGSPHSKALRFQT

SEQ ID NO: 1055 - protein, 18 aa, synthetic construct
KTINGSGSPHSKRTFQQT

SEQ ID NO: 1056 - protein, 18 aa, synthetic construct
KTINGSGSPHSKAQKRLT

SEQ ID NO: 1057 - protein, 18 aa, synthetic construct
KTINGSGSPHLWSQNQQT

SEQ ID NO: 1058 - protein, 18 aa, synthetic construct
KTINGSGSPHLLWQNQQT

SEQ ID NO: 1059 - protein, 18 aa, synthetic construct
KTINGSGSPHSRLRNQQT

SEQ ID NO: 1060 - protein, 18 aa, synthetic construct
KTINGSGSPHSKRAAQQT

SEQ ID NO: 1061 - protein, 18 aa, synthetic construct
KTINGSGSPHSKRSWQQT

SEQ ID NO: 1062 - protein, 18 aa, synthetic construct
KTINGSGSPHSKAQLRRT

SEQ ID NO: 1063 - protein, 18 aa, synthetic construct
KTINGSGSPHYLVQNQQT

SEQ ID NO: 1064 - protein, 18 aa, synthetic construct
KTINGSGSPHSKLFRQQT

SEQ ID NO: 1065 - protein, 18 aa, synthetic construct
KTINGSGSPHSKRAMQQT

SEQ ID NO: 1066 - protein, 18 aa, synthetic construct
KTINGSGSPHSKTLRQQT

SEQ ID NO: 1067 - protein, 18 aa, synthetic construct
KTINGSGSPHSRSRNQQT

SEQ ID NO: 1068 - protein, 18 aa, synthetic construct
KTINGSGSPHRRRQNQQT

SEQ ID NO: 1069 - protein, 18 aa, synthetic construct
KTINGSGSPHSKTCLQQT

SEQ ID NO: 1070 - protein, 18 aa, synthetic construct
KTINGSGSPHSKSRWQQT

SEQ ID NO: 1071 - protein, 18 aa, synthetic construct
KTINGSGSPHRFRQNQQT

SEQ ID NO: 1072 - protein, 18 aa, synthetic construct
KTINGLRSPHRKAQNQQT

SEQ ID NO: 1073 - protein, 18 aa, synthetic construct
KTRSRSGSPHSKAQNQQT

SEQ ID NO: 1074 - protein, 18 aa, synthetic construct
KTINGSGSPHSKAQLVVT

SEQ ID NO: 1075 - protein, 18 aa, synthetic construct
KTINGSGSPHSRKLNQQT

SEQ ID NO: 1076 - protein, 18 aa, synthetic construct
KTINGSGSPHSLLCNQQT

SEQ ID NO: 1077 - protein, 18 aa, synthetic construct
KTINGKRSPHSKAQNQQT

SEQ ID NO: 1078 - protein, 18 aa, synthetic construct
KTINGSRSPHLFAQNQQT

SEQ ID NO: 1079 - protein, 18 aa, synthetic construct
KSINGSGSPHSKAHDQQT

SEQ ID NO: 1080 - protein, 18 aa, synthetic construct
KTINGSGSPHSKAQRSRT

SEQ ID NO: 1081 - protein, 18 aa, synthetic construct
KTINGSGSPHSTWLNQQT

SEQ ID NO: 1082 - protein, 18 aa, synthetic construct
KTINGSGSPHSKASRRQT

SEQ ID NO: 1083 - protein, 18 aa, synthetic construct
KTINGSGSPHSKRSMQQT

SEQ ID NO: 1084 - protein, 18 aa, synthetic construct
KTINGSGSPHSCLQNQQT

SEQ ID NO: 1085 - protein, 18 aa, synthetic construct
KTINGSGSPHSKRLWQQT

SEQ ID NO: 1086 - protein, 18 aa, synthetic construct
KTINGSGSPHSWLSNQQT

SEQ ID NO: 1087 - protein, 18 aa, synthetic construct
KTINGSGSPHLRRQNQQT

SEQ ID NO: 1088 - protein, 18 aa, synthetic construct
KTINGSGSPHSKARRSQT

SEQ ID NO: 1089 - protein, 18 aa, synthetic construct
KTINGSGSPHSKHLRQQT

SEQ ID NO: 1090 - protein, 18 aa, synthetic construct
KTINGSGSPHSCSQNQQT

SEQ ID NO: 1091 - protein, 18 aa, synthetic construct
KTINGSGSPHSKSFRQQT

SEQ ID NO: 1092 - protein, 18 aa, synthetic construct
KTINGSGSPHLCLQNQQT

SEQ ID NO: 1093 - protein, 18 aa, synthetic construct
KTINGSGSPHSKAQTSRT

SEQ ID NO: 1094 - protein, 18 aa, synthetic construct
KTINGSGSPHSLCSNQQT

SEQ ID NO: 1095 - protein, 18 aa, synthetic construct
KTINGSRSPHLRAQNQQT

SEQ ID NO: 1096 - protein, 18 aa, synthetic construct
KTINGSGSPHSKAQVSKT

SEQ ID NO: 1097 - protein, 18 aa, synthetic construct
KTINGSGSPHSKAQRHVT

SEQ ID NO: 1098 - protein, 18 aa, synthetic construct
KTINGSSSPHLCAQNQQT

SEQ ID NO: 1099 - protein, 18 aa, synthetic construct
KTINGSGSPHSFLRNQQT

SEQ ID NO: 1100 - protein, 18 aa, synthetic construct
KTINGSGSPHSFVLNQQT

SEQ ID NO: 1101 - protein, 18 aa, synthetic construct
KTINGSGSPHSKMRAQQT

SEQ ID NO: 1102 - protein, 18 aa, synthetic construct
KTINGSGSPHRPRQNQQT

SEQ ID NO: 1103 - protein, 18 aa, synthetic construct
KTINGSGSPHSKCLLQQT

SEQ ID NO: 1104 - protein, 18 aa, synthetic construct
KTINGSGSPHSKAQSRRT

SEQ ID NO: 1105 - protein, 18 aa, synthetic construct
KTINGSGSPHSRWQNQQT

SEQ ID NO: 1106 - protein, 18 aa, synthetic construct
KYSVGSGSPHSKAQNQQT

SEQ ID NO: 1107 - protein, 18 aa, synthetic construct
KTINGSGSPHSKRFLQQT

SEQ ID NO: 1108 - protein, 18 aa, synthetic construct
KTINGSGSPHSLFLNQQT

SEQ ID NO: 1109 - protein, 18 aa, synthetic construct
KTINGSGSPHSKAYLRQT

SEQ ID NO: 1110 - protein, 18 aa, synthetic construct
KTINGSGSPHSKRNGQQT

SEQ ID NO: 1111 - protein, 18 aa, synthetic construct
KTINGSGSPHTRRQNQQT

SEQ ID NO: 1112 - protein, 18 aa, synthetic construct
KTINGSGSPHSKPRLQQT

SEQ ID NO: 1113 - protein, 18 aa, synthetic construct
KTINFLRSPHSKAQNQQT

SEQ ID NO: 1114 - protein, 18 aa, synthetic construct
KTINGSGSPHLLCQNQQT

SEQ ID NO: 1115 - protein, 18 aa, synthetic construct
KTINGSGSPHSKARIVQT

SEQ ID NO: 1116 - protein, 18 aa, synthetic construct
KTINGSKSPHFKAQNQQT

SEQ ID NO: 1117 - protein, 18 aa, synthetic construct
KTINGSGSPHSKAQIRLT

SEQ ID NO: 1118 - protein, 18 aa, synthetic construct
KTINGSSSPHWVAQNQQT

SEQ ID NO: 1119 - protein, 18 aa, synthetic construct
KTINGSGSPHSKATRRQT

SEQ ID NO: 1120 - protein, 18 aa, synthetic construct
KTINGSLSPHSCAQNQQT

SEQ ID NO: 1121 - protein, 18 aa, synthetic construct
KTINGSGSPHSLYLNQQT

SEQ ID NO: 1122 - protein, 18 aa, synthetic construct
KTINGSGSPHSKVGRQQT

SEQ ID NO: 1123 - protein, 18 aa, synthetic construct
KTINGSGSPHSRRLNQQT

SEQ ID NO: 1124 - protein, 18 aa, synthetic construct
KTINGSGSPHSKAQHSRT

SEQ ID NO: 1125 - protein, 18 aa, synthetic construct
KTINGSGSPHSKAFPRQT

SEQ ID NO: 1126 - protein, 18 aa, synthetic construct
KTINGSPSPHRRAQNQQT

SEQ ID NO: 1127 - protein, 18 aa, synthetic construct
KTINGSGSPHSKRNLQQT

SEQ ID NO: 1128 - protein, 18 aa, synthetic construct
KTINGSGSPHSKPTRQQT

SEQ ID NO: 1129 - protein, 18 aa, synthetic construct
KTINGSGSPHSKLWLQQT

SEQ ID NO: 1130 - protein, 18 aa, synthetic construct
KTINGSGSPHWLAQNQQT

SEQ ID NO: 1131 - protein, 18 aa, synthetic construct
KTINGSGSPHRTRQNQQT

SEQ ID NO: 1132 - protein, 18 aa, synthetic construct
KTINGSGSPHSKLNKQQT

SEQ ID NO: 1133 - protein, 18 aa, synthetic construct
KTINGSGSPHSSLWNQQT

SEQ ID NO: 1134 - protein, 18 aa, synthetic construct
KTINGSGSPHSKAQITLT

SEQ ID NO: 1135 - protein, 18 aa, synthetic construct
KTINGSGSPHSKFLFQQT

SEQ ID NO: 1136 - protein, 18 aa, synthetic construct
KTINGSGSPHSKRTPQQT

SEQ ID NO: 1137 - protein, 18 aa, synthetic construct
KTINGSGSPHSKAQNSRR

SEQ ID NO: 1138 - protein, 18 aa, synthetic construct
KTINGSGSPHSRLKNQQT

SEQ ID NO: 1139 - protein, 18 aa, synthetic construct
KTINGSGSPHSCLLNQQT

SEQ ID NO: 1140 - protein, 18 aa, synthetic construct
KTINGSGSPHTLYQNQQT

SEQ ID NO: 1141 - protein, 18 aa, synthetic construct
KTINGSGSPHSKYPSQQT

SEQ ID NO: 1142 - protein, 18 aa, synthetic construct
KTINGSGSPHSKLRNQQT

SEQ ID NO: 1143 - protein, 18 aa, synthetic construct
KTINGSGSPHLNWQNQQT

SEQ ID NO: 1144 - protein, 18 aa, synthetic construct
KTINGVVSPHRKAQNQQT

SEQ ID NO: 1145 - protein, 18 aa, synthetic construct
KTINGSGSPHSYRPNQQT

SEQ ID NO: 1146 - protein, 18 aa, synthetic construct
KTINGSTSPHRRAQNQQT

SEQ ID NO: 1147 - protein, 18 aa, synthetic construct
KTINGSCSPHPLAQNQQT

SEQ ID NO: 1148 - protein, 18 aa, synthetic construct
KTINGSGSPHSKAFARQT

SEQ ID NO: 1149 - protein, 18 aa, synthetic construct
KTINGSGSPHSKALRYQT

SEQ ID NO: 1150 - protein, 18 aa, synthetic construct
KTINGSKSPHRLAQNQQT

SEQ ID NO: 1151 - protein, 18 aa, synthetic construct
KTINMRVSPHSKAQNQQT

SEQ ID NO: 1152 - protein, 18 aa, synthetic construct
KTINGSGSPHMYLQNQQT

SEQ ID NO: 1153 - protein, 18 aa, synthetic construct
KTINGSGSPHSKLARQQT

SEQ ID NO: 1154 - protein, 18 aa, synthetic construct
KTINGSGSPHSKARPYQT

SEQ ID NO: 1155 - protein, 18 aa, synthetic construct
KTINGSGSPHSKRVPQQT

SEQ ID NO: 1156 - protein, 18 aa, synthetic construct
KTINGSGSPHLSWQNQQT

SEQ ID NO: 1157 - protein, 18 aa, synthetic construct
KTINGRSSPHGKAQNQQT

SEQ ID NO: 1158 - protein, 18 aa, synthetic construct
KTINGSGSPHLWTQNQQT

SEQ ID NO: 1159 - protein, 18 aa, synthetic construct
KTINGLLSPHRKAQNQQT

SEQ ID NO: 1160 - protein, 18 aa, synthetic construct
KTINGSGSPHRLRQNQQT

SEQ ID NO: 1161 - protein, 18 aa, synthetic construct
KTINGSCSPHSGAQNQQT

SEQ ID NO: 1162 - protein, 18 aa, synthetic construct
KTINGSGSPHSKAQRRST

SEQ ID NO: 1163 - protein, 18 aa, synthetic construct
KTINGSGSPHSKLCSQQT

SEQ ID NO: 1164 - protein, 18 aa, synthetic construct
KTINGSGSPHSKAQLLKT

SEQ ID NO: 1165 - protein, 18 aa, synthetic construct
KTINGRKSPHSKAQNQQT

SEQ ID NO: 1166 - protein, 18 aa, synthetic construct
KTINGSGSPHLLYQNQQT

SEQ ID NO: 1167 - protein, 18 aa, synthetic construct
KTINGSGSPHSKLLRQQT

SEQ ID NO: 1168 - protein, 18 aa, synthetic construct
KTINGSGSPHSLRHNQQT

SEQ ID NO: 1169 - protein, 18 aa, synthetic construct
KTINGSGSPHSSKRNQQT

SEQ ID NO: 1170 - protein, 18 aa, synthetic construct
KTINGSGSPHSKARSRQT

SEQ ID NO: 1171 - protein, 18 aa, synthetic construct
KTINGRSSPHRKAQNQQT

SEQ ID NO: 1172 - protein, 18 aa, synthetic construct
KTINGSKSPHRTAQNQQT

SEQ ID NO: 1173 - protein, 18 aa, synthetic construct
KTINGMRSPHVKAQNQQT

SEQ ID NO: 1174 - protein, 18 aa, synthetic construct
KTINGSGSPHSKRMSQQT

SEQ ID NO: 1175 - protein, 18 aa, synthetic construct
KTINGSGSPHSKVPKQQT

SEQ ID NO: 1176 - protein, 18 aa, synthetic construct
KTINLIRSPHSKAQNQQT

SEQ ID NO: 1177 - protein, 18 aa, synthetic construct
KTINGSGSPHPFLQNQQT

SEQ ID NO: 1178 - protein, 18 aa, synthetic construct
KTINGSGSPHSKARLWQT

SEQ ID NO: 1179 - protein, 18 aa, synthetic construct
KTINGSGSPHSRTRNQQT

SEQ ID NO: 1180 - protein, 18 aa, synthetic construct
KTINGSGSPHSKRSNQQT

SEQ ID NO: 1181 - protein, 18 aa, synthetic construct
KTINGSLSPHSWAQNQQT

SEQ ID NO: 1182 - protein, 18 aa, synthetic construct
KTINGSRSPHYKAQNQQT

SEQ ID NO: 1183 - protein, 18 aa, synthetic construct
KTINRHSSPHSKAQNQQT

SEQ ID NO: 1184 - protein, 18 aa, synthetic construct
KTINGSGSPHSKRRNQQT

SEQ ID NO: 1185 - protein, 18 aa, synthetic construct
KTINGSGSPHSKAKHLQT

SEQ ID NO: 1186 - protein, 18 aa, synthetic construct
KTINGSGSPHSKRTYQQT

SEQ ID NO: 1187 - protein, 18 aa, synthetic construct
KTINGVLSPHRKAQNQQT

SEQ ID NO: 1188 - protein, 18 aa, synthetic construct
KTINGSGSPHSFITNQQT

SEQ ID NO: 1189 - protein, 18 aa, synthetic construct
KTINGSGSPHSTRLNQQT

SEQ ID NO: 1190 - protein, 18 aa, synthetic construct
KTINGSGSPHSKRTSQQT

SEQ ID NO: 1191 - protein, 18 aa, synthetic construct
KTINGSGSPHSRRSNQQT

SEQ ID NO: 1192 - protein, 18 aa, synthetic construct
KTINGHLSPHRKAQNQQT

SEQ ID NO: 1193 - protein, 18 aa, synthetic construct
KTINGSGSPHSKAQFSRT

SEQ ID NO: 1194 - protein, 18 aa, synthetic construct
KTINGSGSPHSKAQTFRT

SEQ ID NO: 1195 - protein, 18 aa, synthetic construct
KTINGSGSPHSKPLRQQT

SEQ ID NO: 1196 - protein, 18 aa, synthetic construct
KTINGSGSPHSKASCRQT

SEQ ID NO: 1197 - protein, 18 aa, synthetic construct
KTINGSGSPHSKILWQQT

SEQ ID NO: 1198 - protein, 18 aa, synthetic construct
KTINGSGSPHSKALKRQT

SEQ ID NO: 1199 - protein, 18 aa, synthetic construct
KTINGSGSPHSKAHRSQT

SEQ ID NO: 1200 - protein, 18 aa, synthetic construct
KTINGSGSPHSMLYNQQT

SEQ ID NO: 1201 - protein, 18 aa, synthetic construct
KTINGSGSPHSKCTLQQT

SEQ ID NO: 1202 - protein, 18 aa, synthetic construct
KTINGSGSPHSKAQNRMR

SEQ ID NO: 1203 - protein, 18 aa, synthetic construct
KTINGSGSPHSKLVRQQT

SEQ ID NO: 1204 - protein, 18 aa, synthetic construct
KTINGSGSPHSKRILQQT

SEQ ID NO: 1205 - protein, 18 aa, synthetic construct
KTINGSGSPHSKAQWLRT

SEQ ID NO: 1206 - protein, 18 aa, synthetic construct
KTINGSGSPHSLTCNQQT

SEQ ID NO: 1207 - protein, 18 aa, synthetic construct
KTINGIRSPHTKAQNQQT

SEQ ID NO: 1208 - protein, 18 aa, synthetic construct
KTINGSGSPHSKAQRWLT

SEQ ID NO: 1209 - protein, 18 aa, synthetic construct
KTINGSGSPHSKAQLSIT

SEQ ID NO: 1210 - protein, 18 aa, synthetic construct
KTINGSGSPHIYRQNQQT

SEQ ID NO: 1211 - protein, 18 aa, synthetic construct
KTINGSGSPHSLRSNQQT

SEQ ID NO: 1212 - protein, 18 aa, synthetic construct
KTINGSGSPHSKVKPQQT

SEQ ID NO: 1213 - protein, 18 aa, synthetic construct
KTINGSGSPHSKATRHQT

SEQ ID NO: 1214 - protein, 18 aa, synthetic construct
KTINGSLSPHLCAQNQQT

SEQ ID NO: 1215 - protein, 18 aa, synthetic construct
KTINGSGSPHSKACASQT

SEQ ID NO: 1216 - protein, 18 aa, synthetic construct
KWSPGSGSPHSKAQNQQT

SEQ ID NO: 1217 - protein, 18 aa, synthetic construct
KTINGYLSPHRKAQNQQT

SEQ ID NO: 1218 - protein, 18 aa, synthetic construct
KTINGSGSPHSKVIRQQT

SEQ ID NO: 1219 - protein, 18 aa, synthetic construct
KTINGSGSPHFLLQNQQT

SEQ ID NO: 1220 - protein, 18 aa, synthetic construct
KTINGSGSPHSKARSKQT

SEQ ID NO: 1221 - protein, 18 aa, synthetic construct
KTINGVPSPHWKAQNQQT

SEQ ID NO: 1222 - protein, 18 aa, synthetic construct
KTINGSGSPHSKATRNQT

SEQ ID NO: 1223 - protein, 18 aa, synthetic construct
KTINGSGSPHSKACSAQT

SEQ ID NO: 1224 - protein, 18 aa, synthetic construct
KTINGSGSPHSKARYVQT

SEQ ID NO: 1225 - protein, 18 aa, synthetic construct
KTINGSRSPHARAQNQQT

SEQ ID NO: 1226 - protein, 18 aa, synthetic construct
KTINGSGSPHSKAQHLRT

SEQ ID NO: 1227 - protein, 18 aa, synthetic construct
KTINGSGSPHSKAKSRQT

SEQ ID NO: 1228 - protein, 18 aa, synthetic construct
KTINGSGSPHSKIGRQQT

SEQ ID NO: 1229 - protein, 18 aa, synthetic construct
KTINGLASPHRKAQNQQT

SEQ ID NO: 1230 - protein, 18 aa, synthetic construct
KTINGSGSPHSKARTRQT

SEQ ID NO: 1231 - protein, 18 aa, synthetic construct
KTINGSGSPHSKSIRQQT

SEQ ID NO: 1232 - protein, 18 aa, synthetic construct
KTINGSGSPHSKRLYQQT

SEQ ID NO: 1233 - protein, 18 aa, synthetic construct
KTINGLPSPHRKAQNQQT

SEQ ID NO: 1234 - protein, 18 aa, synthetic construct
KTINGSLSPHRRAQNQQT

SEQ ID NO: 1235 - protein, 18 aa, synthetic construct
KTINGKTSPHGKAQNQQT

SEQ ID NO: 1236 - protein, 18 aa, synthetic construct
KTINGSRSPHRLAQNQQT

SEQ ID NO: 1237 - protein, 18 aa, synthetic construct
KTINGSGSPHSLTWNQQT

SEQ ID NO: 1238 - protein, 18 aa, synthetic construct
KTINGSKSPHRKAQNQQT

SEQ ID NO: 1239 - protein, 18 aa, synthetic construct
KTINGSGSPHSKAQLRKT

SEQ ID NO: 1240 - protein, 18 aa, synthetic construct
KTINGSGSPHSKSRHQQT

SEQ ID NO: 1241 - protein, 18 aa, synthetic construct
KTINRRLSPHSKAQNQQT

SEQ ID NO: 1242 - protein, 18 aa, synthetic construct
KTINGSGSPHSRRVNQQT

SEQ ID NO: 1243 - protein, 18 aa, synthetic construct
KTINGSGSPHSHWQNQQT

SEQ ID NO: 1244 - protein, 18 aa, synthetic construct
KTTHCSGSPHSKAQNQQT

SEQ ID NO: 1245 - protein, 18 aa, synthetic construct
KTINGSGSPHSWLQNQQT

SEQ ID NO: 1246 - protein, 18 aa, synthetic construct
KTINGSTSPHYLAQNQQT

SEQ ID NO: 1247 - protein, 18 aa, synthetic construct
KTINGLTSPHRKAQNQQT

SEQ ID NO: 1248 - protein, 18 aa, synthetic construct
KTINGSGSPHSKRLLQQT

SEQ ID NO: 1249 - protein, 18 aa, synthetic construct
KTINGSGSPHSKLCVQQT

SEQ ID NO: 1250 - protein, 18 aa, synthetic construct
KTINGFLSPHRKAQNQQT

SEQ ID NO: 1251 - protein, 18 aa, synthetic construct
KTINGSGSPHSKMRPQQT

SEQ ID NO: 1252 - protein, 18 aa, synthetic construct
KTINGSGSPHSKQTRQQT

SEQ ID NO: 1253 - protein, 18 aa, synthetic construct
KTINGSGSPHSYLINQQT

SEQ ID NO: 1254 - protein, 18 aa, synthetic construct
KTINGSGSPHSKALRSQT

SEQ ID NO: 1255 - protein, 18 aa, synthetic construct
KTINGMLSPHRKAQNQQT

SEQ ID NO: 1256 - protein, 18 aa, synthetic construct
KTINGSGSPHSKCLTQQT

SEQ ID NO: 1257 - protein, 18 aa, synthetic construct
KTINGSGSPHSKAQLTLT

SEQ ID NO: 1258 - protein, 18 aa, synthetic construct
KTINGHSSPHRKAQNQQT

SEQ ID NO: 1259 - protein, 18 aa, synthetic construct
KTINGSGSPHLTWQNQQT

SEQ ID NO: 1260 - protein, 18 aa, synthetic construct
KTINGSGSPHSKAQYCLT

SEQ ID NO: 1261 - protein, 18 aa, synthetic construct
KTINGSGSPHSFLVNQQT

SEQ ID NO: 1262 - protein, 18 aa, synthetic construct
KTINMSRSPHSKAQNQQT

SEQ ID NO: 1263 - protein, 18 aa, synthetic construct
KTINGSGSPHSKAQLHRT

SEQ ID NO: 1264 - protein, 18 aa, synthetic construct
KTINGSGSPHLYMQNQQT

SEQ ID NO: 1265 - protein, 18 aa, synthetic construct
KTINGSRSPHRRAQNQQT

SEQ ID NO: 1266 - protein, 18 aa, synthetic construct
KTINGSGSPHSKAQNRRS

SEQ ID NO: 1267 - protein, 18 aa, synthetic construct
KTINLRFSPHSKAQNQQT

SEQ ID NO: 1268 - protein, 18 aa, synthetic construct
KTINGSGSPHSKAQRLWT

SEQ ID NO: 1269 - protein, 18 aa, synthetic construct
KTINGSGSPHSKGRAQQT

SEQ ID NO: 1270 - protein, 18 aa, synthetic construct
KTINGSGSPHSLSCNQQT

SEQ ID NO: 1271 - protein, 18 aa, synthetic construct
KTINGLVSPHCKAQNQQT

SEQ ID NO: 1272 - protein, 18 aa, synthetic construct
KTINGSSSPHLWAQNQQT

SEQ ID NO: 1273 - protein, 18 aa, synthetic construct
KTINGSGSPHSKAHRLQT

SEQ ID NO: 1274 - protein, 18 aa, synthetic construct
KTINGSGSPHPYAQNQQT

SEQ ID NO: 1275 - protein, 18 aa, synthetic construct
KTINGSGSPHSTRPNQQT

SEQ ID NO: 1276 - protein, 18 aa, synthetic construct
KTINGRSSPHPKAQNQQT

SEQ ID NO: 1277 - protein, 18 aa, synthetic construct
KTINGSGSPHSKAQSWRT

SEQ ID NO: 1278 - protein, 18 aa, synthetic construct
KTINGQRSPHVKAQNQQT

SEQ ID NO: 1279 - protein, 18 aa, synthetic construct
KTINGSGSPHSKAQFVRT

SEQ ID NO: 1280 - protein, 18 aa, synthetic construct
KTINGSGSPHSKCLNQQT

SEQ ID NO: 1281 - protein, 18 aa, synthetic construct
KTINGSGSPHSSLCNQQT

SEQ ID NO: 1282 - protein, 18 aa, synthetic construct
KTINGQRSPHSKAQNQQT

SEQ ID NO: 1283 - protein, 18 aa, synthetic construct
KTINGSGSPHSLSWNQQT

SEQ ID NO: 1284 - protein, 18 aa, synthetic construct
KTINGSGSPHSSRKNQQT

SEQ ID NO: 1285 - protein, 18 aa, synthetic construct
KTINGSGSPHSKRTLQQT

SEQ ID NO: 1286 - protein, 18 aa, synthetic construct
KTINGSLSPHCLAQNQQT

SEQ ID NO: 1287 - protein, 18 aa, synthetic construct
KTINGSGSPHSKAQSSRT

SEQ ID NO: 1288 - protein, 18 aa, synthetic construct
KTINGSGSPHLKRQNQQT

SEQ ID NO: 1289 - protein, 18 aa, synthetic construct
KTINGSGSPHSKARMGQT

SEQ ID NO: 1290 - protein, 18 aa, synthetic construct
KTINGSGSPHSKAQVKLT

SEQ ID NO: 1291 - protein, 18 aa, synthetic construct
KTINGSGSPHSKLPRQQT

SEQ ID NO: 1292 - protein, 18 aa, synthetic construct
KTINGSGSPHSKLCLQQT

SEQ ID NO: 1293 - protein, 18 aa, synthetic construct
KTINGSGSPHSPLWNQQT

SEQ ID NO: 1294 - protein, 18 aa, synthetic construct
KTINGSVSPHSWAQNQQT

SEQ ID NO: 1295 - protein, 18 aa, synthetic construct
KTIRSKGSPHSKAQNQQT

SEQ ID NO: 1296 - protein, 18 aa, synthetic construct
KTINGSRSPHSWAQNQQT

SEQ ID NO: 1297 - protein, 18 aa, synthetic construct
KTINGSGSPHSKILRQQT

SEQ ID NO: 1298 - protein, 18 aa, synthetic construct
KTINGRQSPHVKAQNQQT

SEQ ID NO: 1299 - protein, 18 aa, synthetic construct
KTINGSGSPHSKAQSIKT

SEQ ID NO: 1300 - protein, 18 aa, synthetic construct
KTINGSGSPHSKAQASKT

SEQ ID NO: 1301 - protein, 18 aa, synthetic construct
KTINGSGSPHSRLFNQQT

SEQ ID NO: 1302 - protein, 18 aa, synthetic construct
KTINGSGSPHIYLQNQQT

SEQ ID NO: 1303 - protein, 18 aa, synthetic construct
KTINGSGSPHSRVRNQQT

SEQ ID NO: 1304 - protein, 18 aa, synthetic construct
KTINGSGSPHSKAVRAQT

SEQ ID NO: 1305 - protein, 18 aa, synthetic construct
KTINGSGSPHSKPARQQT

SEQ ID NO: 1306 - protein, 18 aa, synthetic construct
KTINGSGSPHSRYSNQQT

SEQ ID NO: 1307 - protein, 18 aa, synthetic construct
KTINGSRSPHRSAQNQQT

SEQ ID NO: 1308 - protein, 18 aa, synthetic construct
KTINGSLSPHIYAQNQQT

SEQ ID NO: 1309 - protein, 18 aa, synthetic construct
KTINGSGSPHSKPVRQQT

SEQ ID NO: 1310 - protein, 18 aa, synthetic construct
KTINGMRSPHGKAQNQQT

SEQ ID NO: 1311 - protein, 18 aa, synthetic construct
KTINGSGSPHSKARITQT

SEQ ID NO: 1312 - protein, 18 aa, synthetic construct
KTINGSGSPHSWSLNQQT

SEQ ID NO: 1313 - protein, 18 aa, synthetic construct
KTINTSRSPHSKAQNQQT

SEQ ID NO: 1314 - protein, 18 aa, synthetic construct
KTINGSGSPHSKAFTRQT

SEQ ID NO: 1315 - protein, 18 aa, synthetic construct
KTINGSGSPHSKAVRNQT

SEQ ID NO: 1316 - protein, 18 aa, synthetic construct
KTINGSGSPHSKAQTNRT

SEQ ID NO: 1317 - protein, 18 aa, synthetic construct
KTINGSGSPHSKANRMQT

SEQ ID NO: 1318 - protein, 18 aa, synthetic construct
KTINGSGSPHSKAQLVLT

SEQ ID NO: 1319 - protein, 18 aa, synthetic construct
KTINGSGSPHSKATRQQT

SEQ ID NO: 1320 - protein, 18 aa, synthetic construct
KTINGSGSPHSKARGTQT

SEQ ID NO: 1321 - protein, 18 aa, synthetic construct
KTINGSGSPHSKAQWSVT

SEQ ID NO: 1322 - protein, 18 aa, synthetic construct
KTINGSGSPHSKAWLIQT

SEQ ID NO: 1323 - protein, 18 aa, synthetic construct
KTINGSGSPHSKAFRPQT

SEQ ID NO: 1324 - protein, 18 aa, synthetic construct
KTINGSGSPHRRSQNQQT

SEQ ID NO: 1325 - protein, 18 aa, synthetic construct
KTINGSGSPHSKGIRQQT

SEQ ID NO: 1326 - protein, 18 aa, synthetic construct
KTINGSGSPHCTLQNQQT

SEQ ID NO: 1327 - protein, 18 aa, synthetic construct
KPLPGSGSPHSKAQNQQT

SEQ ID NO: 1328 - protein, 18 aa, synthetic construct
KTINGSGSPHLVCQNQQT

SEQ ID NO: 1329 - protein, 18 aa, synthetic construct
KTINGSGSPHSKARGYQT

SEQ ID NO: 1330 - protein, 18 aa, synthetic construct
KTINGRISPHGKAQNQQT

SEQ ID NO: 1331 - protein, 18 aa, synthetic construct
KTINGSSSPHWLAQNQQT

SEQ ID NO: 1332 - protein, 18 aa, synthetic construct
KTINGSGSPHSKARMAQT

SEQ ID NO: 1333 - protein, 18 aa, synthetic construct
KPLDGSGSPHSKAQNQQT

SEQ ID NO: 1334 - protein, 18 aa, synthetic construct
KPLRGSGSPHSKAQNQQT

SEQ ID NO: 1335 - protein, 18 aa, synthetic construct
KTINGSGSPHSKAQNAKL

SEQ ID NO: 1336 - protein, 18 aa, synthetic construct
KTINGSGSPHSKLSKQQT

SEQ ID NO: 1337 - protein, 18 aa, synthetic construct
KTINGSGSPHSKARNGQT

SEQ ID NO: 1338 - protein, 18 aa, synthetic construct
KTINGSGSPHSKAQRRQT

SEQ ID NO: 1339 - protein, 18 aa, synthetic construct
KTINGSGSPHSKWPGQQT

SEQ ID NO: 1340 - protein, 18 aa, synthetic construct
KTINGSGSPHAFLQNQQT

SEQ ID NO: 1341 - protein, 18 aa, synthetic construct
KTINGILSPHRKAQNQQT

SEQ ID NO: 1342 - protein, 18 aa, synthetic construct
KTINGSGSPHSWGSNQQT

SEQ ID NO: 1343 - protein, 18 aa, synthetic construct
KTINGSGSPHSSCLNQQT

SEQ ID NO: 1344 - protein, 18 aa, synthetic construct
KTINGSGSPHSKAQSVKT

SEQ ID NO: 1345 - protein, 18 aa, synthetic construct
KTINGSGSPHSLRYNQQT

SEQ ID NO: 1346 - protein, 18 aa, synthetic construct
KTINGSGSPHSKARKLQT

SEQ ID NO: 1347 - protein, 18 aa, synthetic construct
KHRSGSGSPHSKAQNQQT

SEQ ID NO: 1348 - protein, 18 aa, synthetic construct
KTINGSGSPHSKWSLQQT

SEQ ID NO: 1349 - protein, 18 aa, synthetic construct
KTINGSGSPHSKAQTMRT

SEQ ID NO: 1350 - protein, 18 aa, synthetic construct
KTINGSGSPHSKTIRQQT

SEQ ID NO: 1351 - protein, 18 aa, synthetic construct
KTINGKLSPHMKAQNQQT

SEQ ID NO: 1352 - protein, 18 aa, synthetic construct
KTINGSGSPHSKARPFQT

SEQ ID NO: 1353 - protein, 18 aa, synthetic construct
KTINGSGSPHSKPRVQQT

SEQ ID NO: 1354 - protein, 18 aa, synthetic construct
KTINGSGSPHSKAQVVLT

SEQ ID NO: 1355 - protein, 18 aa, synthetic construct
KTRRSSGSPHSKAQNQQT

SEQ ID NO: 1356 - protein, 18 aa, synthetic construct
KTINGSGSPHSKPSRQQT

SEQ ID NO: 1357 - protein, 18 aa, synthetic construct
KTINGSGSPHSVYRNQQT

SEQ ID NO: 1358 - protein, 18 aa, synthetic construct
KTINGSGSPHSKTCSQQT

SEQ ID NO: 1359 - protein, 18 aa, synthetic construct
KTINGSPSPHRKAQNQQT

SEQ ID NO: 1360 - protein, 18 aa, synthetic construct
KTINGRSSPHFKAQNQQT

SEQ ID NO: 1361 - protein, 18 aa, synthetic construct
KTINGSGSPHSKAQMVRT

SEQ ID NO: 1362 - protein, 18 aa, synthetic construct
KTINGSRSPHCSAQNQQT

SEQ ID NO: 1363 - protein, 18 aa, synthetic construct
KTINGSCSPHLRAQNQQT

SEQ ID NO: 1364 - protein, 18 aa, synthetic construct
KTINGSGSPHSKAQCLFT

SEQ ID NO: 1365 - protein, 18 aa, synthetic construct
KTINGRPSPHVKAQNQQT

SEQ ID NO: 1366 - protein, 18 aa, synthetic construct
KTINGSGSPHSMFPNQQT

SEQ ID NO: 1367 - protein, 18 aa, synthetic construct
KTINGMKSPHSKAQNQQT

SEQ ID NO: 1368 - protein, 18 aa, synthetic construct
KTINGSGSPHSKVRAQQT

SEQ ID NO: 1369 - protein, 18 aa, synthetic construct
KGLVGSGSPHSKAQNQQT

SEQ ID NO: 1370 - protein, 18 aa, synthetic construct
KTINGSRSPHVRAQNQQT

SEQ ID NO: 1371 - protein, 18 aa, synthetic construct
KTIRLRGSPHSKAQNQQT

SEQ ID NO: 1372 - protein, 18 aa, synthetic construct
KPRLGSGSPHSKAQNQQT

SEQ ID NO: 1373 - protein, 18 aa, synthetic construct
KTINGSGSPHSKAWYPQT

SEQ ID NO: 1374 - protein, 18 aa, synthetic construct
KTINGSCSPHVRAQNQQT

SEQ ID NO: 1375 - protein, 18 aa, synthetic construct
KTINGSGSPHSKRNVQQT

SEQ ID NO: 1376 - protein, 18 aa, synthetic construct
KTINGSGSPHSKRGLQQT

SEQ ID NO: 1377 - protein, 18 aa, synthetic construct
KTINGSGSPHSKRLAQQT

SEQ ID NO: 1378 - protein, 18 aa, synthetic construct
KTINGSGSPHSKVTRQQT

SEQ ID NO: 1379 - protein, 18 aa, synthetic construct
KTINGSGSPHTWLQNQQT

SEQ ID NO: 1380 - protein, 18 aa, synthetic construct
KTINGSGSPHSKQRSQQT

SEQ ID NO: 1381 - protein, 18 aa, synthetic construct
KTINGSGSPHSKAQRCST

SEQ ID NO: 1382 - protein, 18 aa, synthetic construct
KTINGSPSPHYLAQNQQT

SEQ ID NO: 1383 - protein, 18 aa, synthetic construct
KTINGRRSPHLKAQNQQT

SEQ ID NO: 1384 - protein, 18 aa, synthetic construct
KTINGSGSPHWSLQNQQT

SEQ ID NO: 1385 - protein, 18 aa, synthetic construct
KTINGVTSPHWKAQNQQT

SEQ ID NO: 1386 - protein, 18 aa, synthetic construct
KTINGSGSPHSKAQTTRT

SEQ ID NO: 1387 - protein, 18 aa, synthetic construct
KTINGSGSPHSKAQLFKT

SEQ ID NO: 1388 - protein, 18 aa, synthetic construct
KTINGSGSPHSKARSYQT

SEQ ID NO: 1389 - protein, 18 aa, synthetic construct
KTINGSGSPHSKLSRQQT

SEQ ID NO: 1390 - protein, 18 aa, synthetic construct
KTINGSGSPHLVFQNQQT

SEQ ID NO: 1391 - protein, 18 aa, synthetic construct
KTINGSGSPHSKAQLVKT

SEQ ID NO: 1392 - protein, 18 aa, synthetic construct
KTINGSGSPHSKAQTGRT

SEQ ID NO: 1393 - protein, 18 aa, synthetic construct
KTINGSGSPHSKARYSQT

SEQ ID NO: 1394 - protein, 18 aa, synthetic construct
KTINGRHSPHLKAQNQQT

SEQ ID NO: 1395 - protein, 18 aa, synthetic construct
KTINGSGSPHSFARNQQT

SEQ ID NO: 1396 - protein, 18 aa, synthetic construct
KTINGSGSPHSSCQNQQT

SEQ ID NO: 1397 - protein, 18 aa, synthetic construct
KTINGSGSPHSLFANQQT

SEQ ID NO: 1398 - protein, 18 aa, synthetic construct
KTINGSGSPHSKRLTQQT

SEQ ID NO: 1399 - protein, 18 aa, synthetic construct
KTINGSGSPHSKAQTART

SEQ ID NO: 1400 - protein, 18 aa, synthetic construct
KTINGSGSPHFLNQNQQT

SEQ ID NO: 1401 - protein, 18 aa, synthetic construct
KTINGSGSPHSKAQLILT

SEQ ID NO: 1402 - protein, 18 aa, synthetic construct
KEVGGSGSPHSKAQNQQT

SEQ ID NO: 1403 - protein, 18 aa, synthetic construct
KTINGSRSPHIRAQNQQT

SEQ ID NO: 1404 - protein, 18 aa, synthetic construct
KTINGSGSPHSSWLNQQT

SEQ ID NO: 1405 - protein, 18 aa, synthetic construct
KTINGSMSPHLYAQNQQT

SEQ ID NO: 1406 - protein, 18 aa, synthetic construct
KTINGMSSPHRKAQNQQT

SEQ ID NO: 1407 - protein, 18 aa, synthetic construct
KTINGSGSPHSKPRPQQT

SEQ ID NO: 1408 - protein, 18 aa, synthetic construct
KTINGSGSPHSGLWNQQT

SEQ ID NO: 1409 - protein, 18 aa, synthetic construct
KTINGSGSPHRWAQNQQT

SEQ ID NO: 1410 - protein, 18 aa, synthetic construct
KTINGSGSPHSKIRLQQT

SEQ ID NO: 1411 - protein, 18 aa, synthetic construct
KTINGSGSPHSKFSCQQT

SEQ ID NO: 1412 - protein, 18 aa, synthetic construct
KTINGSGSPHSKSCAQQT

SEQ ID NO: 1413 - protein, 18 aa, synthetic construct
KTINGSGSPHSKRLMQQT

SEQ ID NO: 1414 - protein, 18 aa, synthetic construct
KTSRCSGSPHSKAQNQQT

SEQ ID NO: 1415 - protein, 18 aa, synthetic construct
KTINGSGSPHSFLLNQQT

SEQ ID NO: 1416 - protein, 18 aa, synthetic construct
KTINGSGSPHCSAQNQQT

SEQ ID NO: 1417 - protein, 18 aa, synthetic construct
KTINGSGSPHSKAQPSKT

SEQ ID NO: 1418 - protein, 18 aa, synthetic construct
KTINGSGSPHSYVRNQQT

SEQ ID NO: 1419 - protein, 18 aa, synthetic construct
KTINGSGSPHSKAQQSRT

SEQ ID NO: 1420 - protein, 18 aa, synthetic construct
KTINGSGSPHSFVVNQQT

SEQ ID NO: 1421 - protein, 18 aa, synthetic construct
KTINGFRSPHSKAQNQQT

SEQ ID NO: 1422 - protein, 18 aa, synthetic construct
KTINGSGSPHSKWLVQQT

SEQ ID NO: 1423 - protein, 18 aa, synthetic construct
KTINGSGSPHSKRTAQQT

SEQ ID NO: 1424 - protein, 18 aa, synthetic construct
KTINGLFSPHRKAQNQQT

SEQ ID NO: 1425 - protein, 18 aa, synthetic construct
KTINTIESPHSKAQNQQT

SEQ ID NO: 1426 - protein, 18 aa, synthetic construct
KRLFGSGSPHSKAQNQQT

SEQ ID NO: 1427 - protein, 18 aa, synthetic construct
KTINGSGSPHSKAPNHLT

SEQ ID NO: 1428 - protein, 18 aa, synthetic construct
KTINGSGSPHLFRQNQQT

SEQ ID NO: 1429 - protein, 18 aa, synthetic construct
KTINGSGSPHSKASRHQT

SEQ ID NO: 1430 - protein, 18 aa, synthetic construct
KTINGSGSPHSKLSWQQT

SEQ ID NO: 1431 - protein, 18 aa, synthetic construct
KETAGSGSPHSKAQNQQT

SEQ ID NO: 1432 - protein, 18 aa, synthetic construct
KTINGHRSPHLKAQNQQT

SEQ ID NO: 1433 - protein, 18 aa, synthetic construct
KTINGSGSPHSKGCLQQT

SEQ ID NO: 1434 - protein, 18 aa, synthetic construct
KTINGSGSPHSKAQVLIT

SEQ ID NO: 1435 - protein, 18 aa, synthetic construct
KTINGSGSPHSKLRSQQT

SEQ ID NO: 1436 - protein, 18 aa, synthetic construct
KTINGTLSPHRKAQNQQT

SEQ ID NO: 1437 - protein, 18 aa, synthetic construct
KTINGSGSPHSTWTNQQT

SEQ ID NO: 1438 - protein, 18 aa, synthetic construct
KTINGSGSPHSKAQCRLT

SEQ ID NO: 1439 - protein, 18 aa, synthetic construct
KTINNLRSPHSKAQNQQT

SEQ ID NO: 1440 - protein, 18 aa, synthetic construct
KTINGSGSPHSKARANQT

SEQ ID NO: 1441 - protein, 18 aa, synthetic construct
KTINGRQSPHTKAQNQQT

SEQ ID NO: 1442 - protein, 18 aa, synthetic construct
KTINSARSPHSKAQNQQT

SEQ ID NO: 1443 - protein, 18 aa, synthetic construct
KTINGCSSPHRKAQNQQT

SEQ ID NO: 1444 - protein, 18 aa, synthetic construct
KTINGSVSPHFMAQNQQT

SEQ ID NO: 1445 - protein, 18 aa, synthetic construct
KTINGSGSPHSLCQNQQT

SEQ ID NO: 1446 - protein, 18 aa, synthetic construct
KTINGSLSPHLFAQNQQT

SEQ ID NO: 1447 - protein, 18 aa, synthetic construct
KTINGSGSPHSKACPLQT

SEQ ID NO: 1448 - protein, 18 aa, synthetic construct
KTINGRTSPHRKAQNQQT

SEQ ID NO: 1449 - protein, 18 aa, synthetic construct
KTINGSGSPHSKRATQQT

SEQ ID NO: 1450 - protein, 18 aa, synthetic construct
KTINGSGSPHSKARIMQT

SEQ ID NO: 1451 - protein, 18 aa, synthetic construct
KTINGSGSPHVTWQNQQT

SEQ ID NO: 1452 - protein, 18 aa, synthetic construct
KTINGSGSPHSKRLPQQT

SEQ ID NO: 1453 - protein, 18 aa, synthetic construct
KTINGSGSPHSKAQGFRT

SEQ ID NO: 1454 - protein, 18 aa, synthetic construct
KTINGSGSPHLYGQNQQT

SEQ ID NO: 1455 - protein, 18 aa, synthetic construct
KTINGSGSPHLSCQNQQT

SEQ ID NO: 1456 - protein, 18 aa, synthetic construct
KTINGSGSPHSKAQFTLT

SEQ ID NO: 1457 - protein, 18 aa, synthetic construct
KTINGSRSPHFKAQNQQT

SEQ ID NO: 1458 - protein, 18 aa, synthetic construct
KTINGRPSPHSKAQNQQT

SEQ ID NO: 1459 - protein, 18 aa, synthetic construct
KTINGFSSPHRKAQNQQT

SEQ ID NO: 1460 - protein, 18 aa, synthetic construct
KTINGRASPHVKAQNQQT

SEQ ID NO: 1461 - protein, 18 aa, synthetic construct
KTINGSGSPHSKAQNEVH

SEQ ID NO: 1462 - protein, 18 aa, synthetic construct
KTINGSGSPHSKRSLQQT

SEQ ID NO: 1463 - protein, 18 aa, synthetic construct
KTINGSGSPHRSRQNQQT

SEQ ID NO: 1464 - protein, 18 aa, synthetic construct
KPPTGSGSPHSKAQNQQT

SEQ ID NO: 1465 - protein, 18 aa, synthetic construct
KTINGSGSPHSKAARTQT

SEQ ID NO: 1466 - protein, 18 aa, synthetic construct
KTINGSGSPHSSWANQQT

SEQ ID NO: 1467 - protein, 18 aa, synthetic construct
KTINGSGSPHSKAQRHAT

SEQ ID NO: 1468 - protein, 18 aa, synthetic construct
KTINSPRSPHSKAQNQQT

SEQ ID NO: 1469 - protein, 18 aa, synthetic construct
KTINGSGSPHSKSERQQT

SEQ ID NO: 1470 - protein, 18 aa, synthetic construct
KTINGSGSPHALFQNQQT

SEQ ID NO: 1471 - protein, 18 aa, synthetic construct
KTINGSGSPHSKAQCYVT

SEQ ID NO: 1472 - protein, 18 aa, synthetic construct
KTINGVASPHRKAQNQQT

SEQ ID NO: 1473 - protein, 18 aa, synthetic construct
KTINGSGSPHSALWNQQT

SEQ ID NO: 1474 - protein, 18 aa, synthetic construct
KTINGSGSPHSKSVRQQT

SEQ ID NO: 1475 - protein, 18 aa, synthetic construct
KTINGSGSPHSHMENQQT

SEQ ID NO: 1476 - protein, 18 aa, synthetic construct
KTINGSGTPHSKAQNQQT

SEQ ID NO: 1477 - protein, 18 aa, synthetic construct
KTINGSGSPHSKTGRQQT

SEQ ID NO: 1478 - protein, 18 aa, synthetic construct
KTINGSGSPHSKAQANRT

SEQ ID NO: 1479 - protein, 18 aa, synthetic construct
KTINGSGSPHSKARFSQT

SEQ ID NO: 1480 - protein, 18 aa, synthetic construct
KYLLGSGSPHSKAQNQQT

SEQ ID NO: 1481 - protein, 18 aa, synthetic construct
KTINGSGSPHCSSQNQQT

SEQ ID NO: 1482 - protein, 18 aa, synthetic construct
KTINGSMSPHRKAQNQQT

SEQ ID NO: 1483 - protein, 18 aa, synthetic construct
KTINGNLSPHRKAQNQQT

SEQ ID NO: 1484 - protein, 18 aa, synthetic construct
KEVAGSGSPHSKAQNQQT

SEQ ID NO: 1485 - protein, 18 aa, synthetic construct
KTINLSRSPHSKAQNQQT

SEQ ID NO: 1486 - protein, 18 aa, synthetic construct
KTINGSGSPHSKARQQQT

SEQ ID NO: 1487 - protein, 18 aa, synthetic construct
KTINGTPSPHRKAQNQQT

SEQ ID NO: 1488 - protein, 18 aa, synthetic construct
KTINGSGSPHSKFKLQQT

SEQ ID NO: 1489 - protein, 18 aa, synthetic construct
KTINGSGSPHSKAWLLQT

SEQ ID NO: 1490 - protein, 18 aa, synthetic construct
KTINGLRSPHSKAQNQQT

SEQ ID NO: 1491 - protein, 18 aa, synthetic construct
KTINGRLSPHRKAQNQQT

SEQ ID NO: 1492 - protein, 18 aa, synthetic construct
KTINGSPSPHLFAQNQQT

SEQ ID NO: 1493 - protein, 18 aa, synthetic construct
KDLRGSGSPHSKAQNQQT

SEQ ID NO: 1494 - protein, 18 aa, synthetic construct
KTINGSGSPHSKAQLAKT

SEQ ID NO: 1495 - protein, 18 aa, synthetic construct
KTINGSGSPHSKPRSQQT

SEQ ID NO: 1496 - protein, 18 aa, synthetic construct
KTINGSGSPHSKKMSQQT

SEQ ID NO: 1497 - protein, 18 aa, synthetic construct
KTINGSGSPHSKAQLIVT

SEQ ID NO: 1498 - protein, 18 aa, synthetic construct
KTINGSGSPHSKARFTQT

SEQ ID NO: 1499 - protein, 18 aa, synthetic construct
KTINGSGSPHPLFQNQQT

SEQ ID NO: 1500 - protein, 18 aa, synthetic construct
KTINGSGSPHSKAQRGMT

SEQ ID NO: 1501 - protein, 18 aa, synthetic construct
KTINGSGSPHSKAQNLRR

SEQ ID NO: 1502 - protein, 18 aa, synthetic construct
KTINGSGSPHSKAQFRVT

SEQ ID NO: 1503 - protein, 18 aa, synthetic construct
KTINGSGSPHSKAFVRQT

SEQ ID NO: 1504 - protein, 18 aa, synthetic construct
KTINGSGSPHSKARLTQT

SEQ ID NO: 1505 - protein, 18 aa, synthetic construct
KTINGSGSPHRFKQNQQT

SEQ ID NO: 1506 - protein, 18 aa, synthetic construct
KTINGSGSPHSKEETQQT

SEQ ID NO: 1507 - protein, 18 aa, synthetic construct
KTINGSGSPHSKTRAQQT

SEQ ID NO: 1508 - protein, 18 aa, synthetic construct
KTINGSGSPHSVSWNQQT

SEQ ID NO: 1509 - protein, 18 aa, synthetic construct
KTINGSGSPHTKWQNQQT

SEQ ID NO: 1510 - protein, 18 aa, synthetic construct
KTINGSNSPHRKAQNQQT

SEQ ID NO: 1511 - protein, 18 aa, synthetic construct
KTINGSGSPHSKAQNKRS

SEQ ID NO: 1512 - protein, 18 aa, synthetic construct
KTINGSGSPHSTRQNQQT

SEQ ID NO: 1513 - protein, 18 aa, synthetic construct
KTINGTRSPHTKAQNQQT

SEQ ID NO: 1514 - protein, 18 aa, synthetic construct
KTINGSGSPHVLFQNQQT

SEQ ID NO: 1515 - protein, 18 aa, synthetic construct
KTINGSVSPHYLAQNQQT

SEQ ID NO: 1516 - protein, 18 aa, synthetic construct
KTINGALSPHRKAQNQQT

SEQ ID NO: 1517 - protein, 18 aa, synthetic construct
KTINGSGSPHSKARLYQT

SEQ ID NO: 1518 - protein, 18 aa, synthetic construct
KTINGSGSPHEHNQNQQT

SEQ ID NO: 1519 - protein, 18 aa, synthetic construct
KTINGVLSPHWKAQNQQT

SEQ ID NO: 1520 - protein, 18 aa, synthetic construct
KTINGSGSPHSKASRQQT

SEQ ID NO: 1521 - protein, 18 aa, synthetic construct
KTINGSGSPHSKRSFQQT

SEQ ID NO: 1522 - protein, 18 aa, synthetic construct
KTINGSGSPHSKRVSQQT

SEQ ID NO: 1523 - protein, 18 aa, synthetic construct
KTINGSGSPHSYSRNQQT

SEQ ID NO: 1524 - protein, 18 aa, synthetic construct
KTINGSGSPHSTVWNQQT

SEQ ID NO: 1525 - protein, 18 aa, synthetic construct
KTINGSGSPHSVLFNQQT

SEQ ID NO: 1526 - protein, 18 aa, synthetic construct
KTINGPLSPHCKAQNQQT

SEQ ID NO: 1527 - protein, 18 aa, synthetic construct
KTINGSGSPHSKRVGQQT

SEQ ID NO: 1528 - protein, 18 aa, synthetic construct
KTINGSGSPHSKLWSQQT

SEQ ID NO: 1529 - protein, 18 aa, synthetic construct
KTINGSGSPHSKAQGVRT

SEQ ID NO: 1530 - protein, 18 aa, synthetic construct
KTINGSVSPHRRAQNQQT

SEQ ID NO: 1531 - protein, 18 aa, synthetic construct
KTINGSGSPHLRFQNQQT

SEQ ID NO: 1532 - protein, 18 aa, synthetic construct
KTINGSASPHVFAQNQQT

SEQ ID NO: 1533 - protein, 18 aa, synthetic construct
KTWVRSGSPHSKAQNQQT

SEQ ID NO: 1534 - protein, 18 aa, synthetic construct
KTINGSGSPHSKARMQQT

SEQ ID NO: 1535 - protein, 18 aa, synthetic construct
KTINGSGSPHSKASRGQT

SEQ ID NO: 1536 - protein, 18 aa, synthetic construct
KTINGSGSPHSKAQVCLT

SEQ ID NO: 1537 - protein, 18 aa, synthetic construct
KTINGSGSPHSKARGVQT

SEQ ID NO: 1538 - protein, 18 aa, synthetic construct
KTINGSGSPHGLWQNQQT

SEQ ID NO: 1539 - protein, 18 aa, synthetic construct
KTINGSGSPHSKAQVWFT

SEQ ID NO: 1540 - protein, 18 aa, synthetic construct
KTINGSGSPHSKAQVTLT

SEQ ID NO: 1541 - protein, 18 aa, synthetic construct
KTINGSGSPHSKAQLRIT

SEQ ID NO: 1542 - protein, 18 aa, synthetic construct
KDSLGSGSPHSKAQNQQT

SEQ ID NO: 1543 - protein, 18 aa, synthetic construct
KTINGSGSPHSKRASQQT

SEQ ID NO: 1544 - protein, 18 aa, synthetic construct
KTINGSGSPHSKRINQQT

SEQ ID NO: 1545 - protein, 18 aa, synthetic construct
KTINGSGSPHSKASKNQT

SEQ ID NO: 1546 - protein, 18 aa, synthetic construct
KTINGSGSPHSKAQLPWT

SEQ ID NO: 1547 - protein, 18 aa, synthetic construct
KTINGSGSPHSKLTRQQT

SEQ ID NO: 1548 - protein, 18 aa, synthetic construct
KTINGSGSPHSKTNRQQT

SEQ ID NO: 1549 - protein, 18 aa, synthetic construct
KTINRVISPHSKAQNQQT

SEQ ID NO: 1550 - protein, 18 aa, synthetic construct
KTINGSGSPHTLWQNQQT

SEQ ID NO: 1551 - protein, 18 aa, synthetic construct
KTINGSGSPHSRRQNQQT

SEQ ID NO: 1552 - protein, 18 aa, synthetic construct
KTINGSGSPHSKGGRQQT

SEQ ID NO: 1553 - protein, 18 aa, synthetic construct
KTINGSESPHDSAQNQQT

SEQ ID NO: 1554 - protein, 18 aa, synthetic construct
KTINGSGSPHSRPRNQQT

SEQ ID NO: 1555 - protein, 18 aa, synthetic construct
KTINGSGSPHSRKQNQQT

SEQ ID NO: 1556 - protein, 18 aa, synthetic construct
KTINGSGSPHSKAQEELT

SEQ ID NO: 1557 - protein, 18 aa, synthetic construct
KTINGWRSPHSKAQNQQT

SEQ ID NO: 1558 - protein, 18 aa, synthetic construct
KTINGSGSPHSLLYNQQT

SEQ ID NO: 1559 - protein, 18 aa, synthetic construct
KTINGSGSPHSFRLNQQT

SEQ ID NO: 1560 - protein, 18 aa, synthetic construct
KTINGSGSPHSKAQFLRT

SEQ ID NO: 1561 - protein, 18 aa, synthetic construct
KTINGSGSPHSKQSRQQT

SEQ ID NO: 1562 - protein, 18 aa, synthetic construct
KTINGSRSPHSKAQNRQT

SEQ ID NO: 1563 - protein, 18 aa, synthetic construct
KTINGRPSPHIKAQNQQT

SEQ ID NO: 1564 - protein, 18 aa, synthetic construct
KTINGSGSPHSKRLVQQT

SEQ ID NO: 1565 - protein, 18 aa, synthetic construct
KGHEGSGSPHSKAQNQQT

SEQ ID NO: 1566 - protein, 18 aa, synthetic construct
KTINGSGSPHSKAQKRST

SEQ ID NO: 1567 - protein, 18 aa, synthetic construct
KTINGSGSPHSYLLNQQT

SEQ ID NO: 1568 - protein, 18 aa, synthetic construct
KTINGSGSPHSKPRGQQT

SEQ ID NO: 1569 - protein, 18 aa, synthetic construct
KTINGSGSPHSKTRLQQT

SEQ ID NO: 1570 - protein, 18 aa, synthetic construct
KTINGSGSPHSKSHRQQT

SEQ ID NO: 1571 - protein, 18 aa, synthetic construct
KEIKGSGSPHSKAQNQQT

SEQ ID NO: 1572 - protein, 18 aa, synthetic construct
KTINGSGSPHSKARGIQT

SEQ ID NO: 1573 - protein, 18 aa, synthetic construct
KTINGYRSPHSKAQNQQT

SEQ ID NO: 1574 - protein, 18 aa, synthetic construct
KTINGSGSPHSKLWTQQT

SEQ ID NO: 1575 - protein, 18 aa, synthetic construct
KTINGSGSPHSKPWLQQT

SEQ ID NO: 1576 - protein, 18 aa, synthetic construct
KTINGSGSPHWSVQNQQT

SEQ ID NO: 1577 - protein, 18 aa, synthetic construct
KTINGSGSPHSKVARQQT

SEQ ID NO: 1578 - protein, 18 aa, synthetic construct
KTINGSGSPHTLFQNQQT

SEQ ID NO: 1579 - protein, 18 aa, synthetic construct
KTINGSCSPHLAAQNQQT

SEQ ID NO: 1580 - protein, 18 aa, synthetic construct
KTINGSGSPHSKTSRQQT

SEQ ID NO: 1581 - protein, 18 aa, synthetic construct
KTINGSGSPHSKAQNARH

SEQ ID NO: 1582 - protein, 18 aa, synthetic construct
KTINGSGSPHSKAQLKLT

SEQ ID NO: 1583 - protein, 18 aa, synthetic construct
KTINGSGSPHSKAQNWRT

SEQ ID NO: 1584 - protein, 18 aa, synthetic construct
KTINGSGSPHFLPQNQQT

SEQ ID NO: 1585 - protein, 18 aa, synthetic construct
KTINGSGSPHSKNVRQQT

SEQ ID NO: 1586 - protein, 18 aa, synthetic construct
KTINGSGSPHFMRQNQQT

SEQ ID NO: 1587 - protein, 18 aa, synthetic construct
KTINGSGSPHGWAQNQQT

SEQ ID NO: 1588 - protein, 18 aa, synthetic construct
KTINGSGSPHFHLQNQQT

SEQ ID NO: 1589 - protein, 18 aa, synthetic construct
KTINGSASPHWSAQNQQT

SEQ ID NO: 1590 - protein, 18 aa, synthetic construct
KTINGSSSPHSWAQNQQT

SEQ ID NO: 1591 - protein, 18 aa, synthetic construct
KTINGSGSPHSKAHRQQT

SEQ ID NO: 1592 - protein, 18 aa, synthetic construct
KTINGSGSPHSKQRVQQT

SEQ ID NO: 1593 - protein, 18 aa, synthetic construct
KTLRRSGSPHSKAQNQQT

SEQ ID NO: 1594 - protein, 18 aa, synthetic construct
KTINGSGSPHSKGVRQQT

SEQ ID NO: 1595 - protein, 18 aa, synthetic construct
KTINGSLSPHTWAQNQQT

SEQ ID NO: 1596 - protein, 18 aa, synthetic construct
KTINGSGSPHSKRALQQT

SEQ ID NO: 1597 - protein, 18 aa, synthetic construct
KTINGSGSPHCLSQNQQT

SEQ ID NO: 1598 - protein, 18 aa, synthetic construct
KTINGSGSPHSKAQSLKT

SEQ ID NO: 1599 - protein, 18 aa, synthetic construct
KTINGSGSPHSFVRNQQT

SEQ ID NO: 1600 - protein, 18 aa, synthetic construct
KTINGSGSPHSIFSNQQT

SEQ ID NO: 1601 - protein, 18 aa, synthetic construct
KTINGSGSPHSKVSRQQT

SEQ ID NO: 1602 - protein, 18 aa, synthetic construct
KTINGSGSPHSKARNKQT

SEQ ID NO: 1603 - protein, 18 aa, synthetic construct
KTINASGSPHSKAQGQQT

SEQ ID NO: 1604 - protein, 18 aa, synthetic construct
KTINGSGSPHSKLRMQQT

SEQ ID NO: 1605 - protein, 18 aa, synthetic construct
KTINGSWSPHMLAQNQQT

SEQ ID NO: 1606 - protein, 18 aa, synthetic construct
KTINGSGSPHSLFPNQQT

SEQ ID NO: 1607 - protein, 18 aa, synthetic construct
KPPLGSGSPHSKAQNQQT

SEQ ID NO: 1608 - protein, 18 aa, synthetic construct
KTINGIASPHRKAQNQQT

SEQ ID NO: 1609 - protein, 18 aa, synthetic construct
KTINGSCSPHSLAQNQQT

SEQ ID NO: 1610 - protein, 18 aa, synthetic construct
KTINGRLSPHFKAQNQQT

SEQ ID NO: 1611 - protein, 18 aa, synthetic construct
KTINGSGSPHSKARMTQT

SEQ ID NO: 1612 - protein, 18 aa, synthetic construct
KTINGSGSPHSKARLQQT

SEQ ID NO: 1613 - protein, 18 aa, synthetic construct
KTINGSGSPHSKWVSQQT

SEQ ID NO: 1614 - protein, 18 aa, synthetic construct
KTINGSGSPHSKKVSQQT

SEQ ID NO: 1615 - protein, 18 aa, synthetic construct
KTINGSGSPHSKAQSYRT

SEQ ID NO: 1616 - protein, 18 aa, synthetic construct
KAFNGSGSPHSKAPNQQT

SEQ ID NO: 1617 - protein, 18 aa, synthetic construct
KTINGSGSPHSKAQYRLT

SEQ ID NO: 1618 - protein, 18 aa, synthetic construct
KTINGSWSPHLVAQNQQT

SEQ ID NO: 1619 - protein, 18 aa, synthetic construct
KTINGSGSPHSWTQNQQT

SEQ ID NO: 1620 - protein, 18 aa, synthetic construct
KTINGSGSPHSKAQSHRT

SEQ ID NO: 1621 - protein, 18 aa, synthetic construct
KGINGSGSPHGKAQNQQT

SEQ ID NO: 1622 - protein, 18 aa, synthetic construct
KTINGSGSPHSKAQNRKL

SEQ ID NO: 1623 - protein, 18 aa, synthetic construct
KTINGRYSPHSKAQNQQT

SEQ ID NO: 1624 - protein, 18 aa, synthetic construct
KTINGSGSPHSKGRSQQT

SEQ ID NO: 1625 - protein, 18 aa, synthetic construct
KTINGSGSPHCVAQNQQT

SEQ ID NO: 1626 - protein, 18 aa, synthetic construct
KTINGSGSPHSKIRPQQT

SEQ ID NO: 1627 - protein, 18 aa, synthetic construct
KTINGSGSPHSKAQSSKT

SEQ ID NO: 1628 - protein, 18 aa, synthetic construct
KTINGSGSPHSKRPFQQT

SEQ ID NO: 1629 - protein, 18 aa, synthetic construct
KTINGSSSPHCLAQNQQT

SEQ ID NO: 1630 - protein, 18 aa, synthetic construct
KTINGTRSPHAKAQNQQT

SEQ ID NO: 1631 - protein, 18 aa, synthetic construct
KTINGSGSPHLLFQNQQT

SEQ ID NO: 1632 - protein, 18 aa, synthetic construct
KTINGRRSPHTKAQNQQT

SEQ ID NO: 1633 - protein, 18 aa, synthetic construct
KTINGSGSPHSKASKQQT

SEQ ID NO: 1634 - protein, 18 aa, synthetic construct
KTINGSGSPHSKAQLGRT

SEQ ID NO: 1635 - protein, 18 aa, synthetic construct
KTINGSGSPHSVFLNQQT

SEQ ID NO: 1636 - protein, 18 aa, synthetic construct
KTINGSGSPHSKSARQQT

SEQ ID NO: 1637 - protein, 18 aa, synthetic construct
KTINGSGSPHSKLRLQQT

SEQ ID NO: 1638 - protein, 18 aa, synthetic construct
KTRKSSGSPHSKAQNQQT

SEQ ID NO: 1639 - protein, 18 aa, synthetic construct
KTINGFRSPHLKAQNQQT

SEQ ID NO: 1640 - protein, 18 aa, synthetic construct
KTINGSGSPHSKRSIQQT

SEQ ID NO: 1641 - protein, 18 aa, synthetic construct
KTINGSGSPHSKGRIQQT

SEQ ID NO: 1642 - protein, 18 aa, synthetic construct
KTINGSRSPHRPAQNQQT

SEQ ID NO: 1643 - protein, 18 aa, synthetic construct
KTINGSGSPHSKLRPQQT

SEQ ID NO: 1644 - protein, 18 aa, synthetic construct
KTINGSGSPHMYAQNQQT

SEQ ID NO: 1645 - protein, 18 aa, synthetic construct
KTINGRTSPHAKAQNQQT

SEQ ID NO: 1646 - protein, 18 aa, synthetic construct
KTINGSGSPHSKAGRGQT

SEQ ID NO: 1647 - protein, 18 aa, synthetic construct
KTINGSGSPHSKLMRQQT

SEQ ID NO: 1648 - protein, 18 aa, synthetic construct
KTINGSGSPHSKANKSQT

SEQ ID NO: 1649 - protein, 18 aa, synthetic construct
KTINGSGSPHSKAVRQQT

SEQ ID NO: 1650 - protein, 18 aa, synthetic construct
KTINGSGSPHSKCLSQQT

SEQ ID NO: 1651 - protein, 18 aa, synthetic construct
KTINGSGSPHSKAQWVLT

SEQ ID NO: 1652 - protein, 18 aa, synthetic construct
KTINGSGSPHSKAQFWVT

SEQ ID NO: 1653 - protein, 18 aa, synthetic construct
KTINGSGSPHSKALCRQT

SEQ ID NO: 1654 - protein, 18 aa, synthetic construct
KEVMGSGSPHSKAQNQQT

SEQ ID NO: 1655 - protein, 18 aa, synthetic construct
KTINGSGSPHSKNTRQQT

SEQ ID NO: 1656 - protein, 18 aa, synthetic construct
KTINGSGSPHTWTQNQQT

SEQ ID NO: 1657 - protein, 18 aa, synthetic construct
KTINGSTSPHWSAQNQQT

SEQ ID NO: 1658 - protein, 18 aa, synthetic construct
KTINGNVSPHRKAQNQQT

SEQ ID NO: 1659 - protein, 18 aa, synthetic construct
KTINGSTSPHLFAQNQQT

SEQ ID NO: 1660 - protein, 18 aa, synthetic construct
KTINGSGSPHSKAQNYRA

SEQ ID NO: 1661 - protein, 18 aa, synthetic construct
KTINGSGSPHSKARGQQT

SEQ ID NO: 1662 - protein, 18 aa, synthetic construct
KTINGSGSPHSKAQNRIR

SEQ ID NO: 1663 - protein, 18 aa, synthetic construct
KTINGSGSPHSKWTLQQT

SEQ ID NO: 1664 - protein, 18 aa, synthetic construct
KTINGSGSPHSKAQMKCT

SEQ ID NO: 1665 - protein, 18 aa, synthetic construct
KTINGSGSPHSLWQNQQT

SEQ ID NO: 1666 - protein, 18 aa, synthetic construct
KTINGSGSPHSKAQLSKT

SEQ ID NO: 1667 - protein, 18 aa, synthetic construct
KTINLIWSPHSKAQNQQT

SEQ ID NO: 1668 - protein, 18 aa, synthetic construct
KTINGSGSPHSKRVLQQT

SEQ ID NO: 1669 - protein, 18 aa, synthetic construct
KTINGSGSPHSKVRVQQT

SEQ ID NO: 1670 - protein, 18 aa, synthetic construct
KTINSRFSPHSKAQNQQT

SEQ ID NO: 1671 - protein, 18 aa, synthetic construct
KRSKGSGSPHSKAQNQQT

SEQ ID NO: 1672 - protein, 18 aa, synthetic construct
KTINGSGSPHRRLQNQQT

SEQ ID NO: 1673 - protein, 18 aa, synthetic construct
KTINGSGSPHSCAQNQQT

SEQ ID NO: 1674 - protein, 18 aa, synthetic construct
KTINGPLSPHRKAQNQQT

SEQ ID NO: 1675 - protein, 18 aa, synthetic construct
KTINGSVSPHLYAQNQQT

SEQ ID NO: 1676 - protein, 18 aa, synthetic construct
KTINGRISPHLKAQNQQT

SEQ ID NO: 1677 - protein, 18 aa, synthetic construct
KTINGSHSPHRKAQNQQT

SEQ ID NO: 1678 - protein, 18 aa, synthetic construct
KTINGSGSPHSKAQVSIT

SEQ ID NO: 1679 - protein, 18 aa, synthetic construct
KTINGSMSPHRRAQNQQT

SEQ ID NO: 1680 - protein, 18 aa, synthetic construct
KTINGRQSPHAKAQNQQT

SEQ ID NO: 1681 - protein, 18 aa, synthetic construct
KTINGSGSPHSKAVWRQT

SEQ ID NO: 1682 - protein, 18 aa, synthetic construct
KQPLGSGSPHSKAQNQQT

SEQ ID NO: 1683 - protein, 18 aa, synthetic construct
KTINGSGSPHSKAQNVKL

SEQ ID NO: 1684 - protein, 18 aa, synthetic construct
KTINGSGSPHSKRGTQQT

SEQ ID NO: 1685 - protein, 18 aa, synthetic construct
KTINGSVSPHYVAQNQQT

SEQ ID NO: 1686 - protein, 18 aa, synthetic construct
KTINGSGSPHSKNLRQQT

SEQ ID NO: 1687 - protein, 18 aa, synthetic construct
KTINGSGSPHSKAQAFRT

SEQ ID NO: 1688 - protein, 18 aa, synthetic construct
KTINGSGSPHSKCSNQQT

SEQ ID NO: 1689 - protein, 18 aa, synthetic construct
KELVGSGSPHSKAQNQQT

SEQ ID NO: 1690 - protein, 18 aa, synthetic construct
KTINGSGSPHSLVFNQQT

SEQ ID NO: 1691 - protein, 18 aa, synthetic construct
KTINGSGSPHSKAQATRT

SEQ ID NO: 1692 - protein, 18 aa, synthetic construct
KTINGTSSPHCKAQNQQT

SEQ ID NO: 1693 - protein, 18 aa, synthetic construct
KTINGSGSPHSKALWRQT

SEQ ID NO: 1694 - protein, 18 aa, synthetic construct
KTINGSGSPHSKAQFSVT

SEQ ID NO: 1695 - protein, 18 aa, synthetic construct
KTINGSGSPHSKLYMQQT

SEQ ID NO: 1696 - protein, 18 aa, synthetic construct
KTINGSLSPHYMAQNQQT

SEQ ID NO: 1697 - protein, 18 aa, synthetic construct
KTINGSGSPHSKAWLMQT

SEQ ID NO: 1698 - protein, 18 aa, synthetic construct
KTINGSGSPHSKSLKQQT

SEQ ID NO: 1699 - protein, 18 aa, synthetic construct
KTINGSGSPHSKAQNTRR

SEQ ID NO: 1700 - protein, 18 aa, synthetic construct
KTINGSGSPHYLLQNQQT

SEQ ID NO: 1701 - protein, 18 aa, synthetic construct
KTINGSGSPHTWSQNQQT

SEQ ID NO: 1702 - protein, 18 aa, synthetic construct
KTINGSGSPHSKTRMQQT

SEQ ID NO: 1703 - protein, 18 aa, synthetic construct
KTINTRPSPHSKAQNQQT

SEQ ID NO: 1704 - protein, 18 aa, synthetic construct
KTINGSGSPHSKAQILVT

SEQ ID NO: 1705 - protein, 18 aa, synthetic construct
KTINGSGSPHSKAQNAKS

SEQ ID NO: 1706 - protein, 18 aa, synthetic construct
KTINGSGSPHSRTYNQQT

SEQ ID NO: 1707 - protein, 18 aa, synthetic construct
KTINGSGSPHSKKGGQQT

SEQ ID NO: 1708 - protein, 18 aa, synthetic construct
KTINGYSSPHRKAQNQQT

SEQ ID NO: 1709 - protein, 18 aa, synthetic construct
KTINGSGSPHWVSQNQQT

SEQ ID NO: 1710 - protein, 18 aa, synthetic construct
KTINGSGSPHSKARLAQT

SEQ ID NO: 1711 - protein, 18 aa, synthetic construct
KTINGMCSPHSKAQNQQT

SEQ ID NO: 1712 - protein, 18 aa, synthetic construct
KTINGSGSPHSKSNKQQT

SEQ ID NO: 1713 - protein, 18 aa, synthetic construct
KTINGSGSPHSKAQFVLT

SEQ ID NO: 1714 - protein, 18 aa, synthetic construct
KTINGSISPHFVAQNQQT

SEQ ID NO: 1715 - protein, 18 aa, synthetic construct
KTINGSGSPHRRMQNQQT

SEQ ID NO: 1716 - protein, 18 aa, synthetic construct
KTINGSGSPHSKAWILQT

SEQ ID NO: 1717 - protein, 18 aa, synthetic construct
KTINGSGSPHSKAQGVKT

SEQ ID NO: 1718 - protein, 18 aa, synthetic construct
KTINGSGSPHSKAQFSLT

SEQ ID NO: 1719 - protein, 18 aa, synthetic construct
KTINMLRSPHSKAQNQQT

SEQ ID NO: 1720 - protein, 18 aa, synthetic construct
KTINGSGSPHSKAQLGKT

SEQ ID NO: 1721 - protein, 18 aa, synthetic construct
KTINGSGSPHSMYLNQQT

SEQ ID NO: 1722 - protein, 18 aa, synthetic construct
KTINGHDSPHVTDQNQQT

SEQ ID NO: 1723 - protein, 18 aa, synthetic construct
KTINGHDSPHKRGQHRQT

SEQ ID NO: 1724 - protein, 18 aa, synthetic construct
KMPEGHDSPHKSGQNQQT

SEQ ID NO: 1725 - protein, 18 aa, synthetic construct
KMEGGHDSPHKSGQNQQT

SEQ ID NO: 1726 - protein, 18 aa, synthetic construct
KMEYGHDSPHKSGQNQQT

SEQ ID NO: 1727 - protein, 18 aa, synthetic construct
KAEWGHDSPHKSGQNQQT

SEQ ID NO: 1728 - protein, 18 aa, synthetic construct
KCEWGHDSPHKSGQNQQT

SEQ ID NO: 1729 - protein, 18 aa, synthetic construct
KANNGQDSPHKSGQNQQT

SEQ ID NO: 1730 - protein, 18 aa, synthetic construct
KTINGHDSPHLCGQNQQT

SEQ ID NO: 1731 - protein, 18 aa, synthetic construct
KIPEGHDSPHKSGQNQQT

SEQ ID NO: 1732 - protein, 18 aa, synthetic construct
KADMGHDSPHKSGQNQQT

SEQ ID NO: 1733 - protein, 18 aa, synthetic construct
KTINGHLSPHYFGQNQQT

SEQ ID NO: 1734 - protein, 18 aa, synthetic construct
KIEYGHDSPHKSGQNQQT

SEQ ID NO: 1735 - protein, 18 aa, synthetic construct
KADYGHDSPHKSGQNQQT

SEQ ID NO: 1736 - protein, 18 aa, synthetic construct
KIETGHDSPHKSGQNQQT

SEQ ID NO: 1737 - protein, 18 aa, synthetic construct
KTINGHDSPHTNGQKQQT

SEQ ID NO: 1738 - protein, 18 aa, synthetic construct
KMEWGHDSPHKSGQNQQT

SEQ ID NO: 1739 - protein, 18 aa, synthetic construct
KTINGHDSPHWLLQNQQT

SEQ ID NO: 1740 - protein, 18 aa, synthetic construct
KCEYGHDSPHKSGQNQQT

SEQ ID NO: 1741 - protein, 18 aa, synthetic construct
KRINGHDSPHKSGQKQQN

SEQ ID NO: 1742 - protein, 18 aa, synthetic construct
KMEIGHDSPHKSGQNQQT

SEQ ID NO: 1743 - protein, 18 aa, synthetic construct
KLEYGHDSPHKSGQNQQT

SEQ ID NO: 1744 - protein, 18 aa, synthetic construct
KADWGHDSPHKSGQNQQT

SEQ ID NO: 1745 - protein, 18 aa, synthetic construct
KIEIGHDSPHKSGQNQQT

SEQ ID NO: 1746 - protein, 18 aa, synthetic construct
KTIKDNDSPHKSGQNQQT

SEQ ID NO: 1747 - protein, 18 aa, synthetic construct
KDIMGHDSPHKSGQNQQT

SEQ ID NO: 1748 - protein, 18 aa, synthetic construct
KFEQGHDSPHKSGQNQQT

SEQ ID NO: 1749 - protein, 18 aa, synthetic construct
KMEFGHDSPHKSGQNQQT

SEQ ID NO: 1750 - protein, 18 aa, synthetic construct
KCDQGHDSPHKSGQNQQT

SEQ ID NO: 1751 - protein, 18 aa, synthetic construct
KLPEGHDSPHKSGQNQQT

SEQ ID NO: 1752 - protein, 18 aa, synthetic construct
KIENGHDSPHKSGQNQQT

SEQ ID NO: 1753 - protein, 18 aa, synthetic construct
KMESGHDSPHKSGQNQQT

SEQ ID NO: 1754 - protein, 18 aa, synthetic construct
KAEIGHDSPHKSGQNQQT

SEQ ID NO: 1755 - protein, 18 aa, synthetic construct
KVEYGHDSPHKSGQNQQT

SEQ ID NO: 1756 - protein, 18 aa, synthetic construct
KIINGHDSPHKSGLTQQT

SEQ ID NO: 1757 - protein, 18 aa, synthetic construct
KTSNGDDSPHKSGRNQQT

SEQ ID NO: 1758 - protein, 18 aa, synthetic construct
KIEVGHDSPHKSGQNQQT

SEQ ID NO: 1759 - protein, 18 aa, synthetic construct
KMEMGHDSPHKSGQNQQT

SEQ ID NO: 1760 - protein, 18 aa, synthetic construct
KAEVGHDSPHKSGQNQQT

SEQ ID NO: 1761 - protein, 18 aa, synthetic construct
KMDAGHDSPHKSGQNQQT

SEQ ID NO: 1762 - protein, 18 aa, synthetic construct
KVEWGHDSPHKSGQNQQT

SEQ ID NO: 1763 - protein, 18 aa, synthetic construct
KAEQGHDSPHKSGQNQQT

SEQ ID NO: 1764 - protein, 18 aa, synthetic construct
KLEWGHDSPHKSGQNQQT

SEQ ID NO: 1765 - protein, 18 aa, synthetic construct
KTINGHPSPHYLGQNQQT

SEQ ID NO: 1766 - protein, 18 aa, synthetic construct
KTINGHLSPHYYGQNQQT

SEQ ID NO: 1767 - protein, 18 aa, synthetic construct
KMELGHDSPHKSGQNQQT

SEQ ID NO: 1768 - protein, 18 aa, synthetic construct
KMETGHDSPHKSGQNQQT

SEQ ID NO: 1769 - protein, 18 aa, synthetic construct
KMEAGHDSPHKSGQNQQT

SEQ ID NO: 1770 - protein, 18 aa, synthetic construct
KTINGHDSPHLLWQNQQT

SEQ ID NO: 1771 - protein, 18 aa, synthetic construct
KTINRQRSPHKSGQNQQT

SEQ ID NO: 1772 - protein, 18 aa, synthetic construct
KIESGHDSPHKSGQNQQT

SEQ ID NO: 1773 - protein, 18 aa, synthetic construct
KTAKDHDSPHKSGQNQQT

SEQ ID NO: 1774 - protein, 18 aa, synthetic construct
KMEVGHDSPHKSGQNQQT

SEQ ID NO: 1775 - protein, 18 aa, synthetic construct
KCEIGHDSPHKSGQNQQT

SEQ ID NO: 1776 - protein, 18 aa, synthetic construct
KATNGHDSPHKSGLNQQT

SEQ ID NO: 1777 - protein, 18 aa, synthetic construct
KMDGGHDSPHKSGQNQQT

SEQ ID NO: 1778 - protein, 18 aa, synthetic construct
KQEVGHDSPHKSGQNQQT

SEQ ID NO: 1779 - protein, 18 aa, synthetic construct
KADQGHDSPHKSGQNQQT

SEQ ID NO: 1780 - protein, 18 aa, synthetic construct
KTINGHESPHKSAQNHQT

SEQ ID NO: 1781 - protein, 18 aa, synthetic construct
KTINGHDSPHKSAQNQWT

SEQ ID NO: 1782 - protein, 18 aa, synthetic construct
KNMNGHDSPHKSGQNTHS

SEQ ID NO: 1783 - protein, 18 aa, synthetic construct
KTPWEHDSPHKSGQNQQT

SEQ ID NO: 1784 - protein, 18 aa, synthetic construct
KTINGHSSPHYFGQNQQT

SEQ ID NO: 1785 - protein, 18 aa, synthetic construct
KIEMGHDSPHKSGQNQQT

SEQ ID NO: 1786 - protein, 18 aa, synthetic construct
KTANEHDSPHKSGQNQQT

SEQ ID NO: 1787 - protein, 18 aa, synthetic construct
KTINGHDSPHKSGRRRQT

SEQ ID NO: 1788 - protein, 18 aa, synthetic construct
KISNGHDSPHKSAQNQQT

SEQ ID NO: 1789 - protein, 18 aa, synthetic construct
KTGNGHDSPHKSGQYQQT

SEQ ID NO: 1790 - protein, 18 aa, synthetic construct
KTINGHYSPHLFGQNQQT

SEQ ID NO: 1791 - protein, 18 aa, synthetic construct
KTINGNYSPHKIGQNQQT

SEQ ID NO: 1792 - protein, 18 aa, synthetic construct
KTINGHDSPHKSRQNDQT

SEQ ID NO: 1793 - protein, 18 aa, synthetic construct
KQQQGHDSPHKSGQNQQT

SEQ ID NO: 1794 - protein, 18 aa, synthetic construct
KTPQDHDSPHKSGQNQQT

SEQ ID NO: 1795 - protein, 18 aa, synthetic construct
KHDWGHDSPHKSGQNQQT

SEQ ID NO: 1796 - protein, 18 aa, synthetic construct
KIEGGHDSPHKSGQNQQT

SEQ ID NO: 1797-1799 - skipped (3 entries)

SEQ ID NO: 1800 - protein, 13 aa, synthetic construct
GHDSPHKSGQNQQ

SEQ ID NO: 1801 - protein, 13 aa, synthetic construct
GSGSPHSKAQNQQ

SEQ ID NO: 1802 - protein, 13 aa, synthetic construct
GSGSPHSKAQNRH

SEQ ID NO: 1803 - protein, 13 aa, synthetic construct
GSGSPHSKVQNQQ

SEQ ID NO: 1804 - protein, 13 aa, synthetic construct
MSGSPHSKAQNQQ

SEQ ID NO: 1805 - protein, 13 aa, synthetic construct
GRGSPHSKAQNQQ

SEQ ID NO: 1806 - protein, 13 aa, synthetic construct
RNGSPHSKAQNQQ

SEQ ID NO: 1807 - protein, 13 aa, synthetic construct
GSGSPHSKARDQQ

SEQ ID NO: 1808 - protein, 13 aa, synthetic construct
GSGSPHSKAPNLQ

SEQ ID NO: 1809 - protein, 13 aa, synthetic construct
TSGSPHSKAQNQQ

SEQ ID NO: 1810 - protein, 13 aa, synthetic construct
GSGSPHSKAHVRQ

SEQ ID NO: 1811 - protein, 13 aa, synthetic construct
GSGSPHSKAPNQH

SEQ ID NO: 1812 - protein, 13 aa, synthetic construct
ISGSPHSKAQNQQ

SEQ ID NO: 1813 - protein, 13 aa, synthetic construct
GPGSPHSKAHNQQ

SEQ ID NO: 1814 - protein, 13 aa, synthetic construct
GSGSPHSKTQSQQ

SEQ ID NO: 1815 - protein, 13 aa, synthetic construct
ESGSPHSKAQNQQ

SEQ ID NO: 1816 - protein, 13 aa, synthetic construct
GSGSPHSKAQPAK

SEQ ID NO: 1817 - protein, 13 aa, synthetic construct
SSGSPHSKAQNQQ

SEQ ID NO: 1818 - protein, 13 aa, synthetic construct
GNGSPHSKAQNQQ

SEQ ID NO: 1819 - protein, 13 aa, synthetic construct
GSGSPHSKSQTQQ

SEQ ID NO: 1820 - protein, 13 aa, synthetic construct
ASGSPHSKAQNQQ

SEQ ID NO: 1821 - protein, 13 aa, synthetic construct
GSGSPHSKAQNLA

SEQ ID NO: 1822 - protein, 13 aa, synthetic construct
GSGSPHSKSQNQL

SEQ ID NO: 1823 - protein, 13 aa, synthetic construct
NSGSPHSKAQNQQ

SEQ ID NO: 1824 - protein, 13 aa, synthetic construct
GSGSPHSKAQGQQ

SEQ ID NO: 1825 - protein, 13 aa, synthetic construct
VSGSPHSKAQNQQ

SEQ ID NO: 1826 - protein, 13 aa, synthetic construct
GSGSPHSKALNRQ

SEQ ID NO: 1827 - protein, 13 aa, synthetic construct
LSGSPHSKAQNQQ

SEQ ID NO: 1828 - protein, 13 aa, synthetic construct
GSGSPHSKAHNQQ

SEQ ID NO: 1829 - protein, 13 aa, synthetic construct
GSGSPHSKTQNQQ

SEQ ID NO: 1830 - protein, 13 aa, synthetic construct
GGGSPHSKAQTQQ

SEQ ID NO: 1831 - protein, 13 aa, synthetic construct
GSGSPHSKAQNPP

SEQ ID NO: 1832 - protein, 13 aa, synthetic construct
GSGSPHSKAQNLQ

SEQ ID NO: 1833 - protein, 13 aa, synthetic construct
GGGSPHSKAQNQQ

SEQ ID NO: 1834 - protein, 13 aa, synthetic construct
GSGSPHSKAQYQQ

SEQ ID NO: 1835 - protein, 13 aa, synthetic construct
GGGSPHSKAQNKQ

SEQ ID NO: 1836 - protein, 13 aa, synthetic construct
GSGSPHSKAQDQE

SEQ ID NO: 1837 - protein, 13 aa, synthetic construct
KSGSPHSKAQNQQ

SEQ ID NO: 1838 - protein, 13 aa, synthetic construct
GGGSPHSKAQNQL

SEQ ID NO: 1839 - protein, 13 aa, synthetic construct
GSGSPHSKAQNHQ

SEQ ID NO: 1840 - protein, 13 aa, synthetic construct
GSGSPHSKAQDQQ

SEQ ID NO: 1841 - protein, 13 aa, synthetic construct
GGGSPHSKSQNQL

SEQ ID NO: 1842 - protein, 13 aa, synthetic construct
GNGSPHSKAQNKQ

SEQ ID NO: 1843 - protein, 13 aa, synthetic construct
GSGSPHSKGHWQQ

SEQ ID NO: 1844 - protein, 13 aa, synthetic construct
GSGSPHSKAPNQQ

SEQ ID NO: 1845 - protein, 13 aa, synthetic construct
GSGSPHSKAQNQL

SEQ ID NO: 1846 - protein, 13 aa, synthetic construct
GSGSPHSKRPEQQ

SEQ ID NO: 1847 - protein, 13 aa, synthetic construct
GSGSPHSKAQRTM

SEQ ID NO: 1848 - protein, 13 aa, synthetic construct
GNGSPHSKAQNQH

SEQ ID NO: 1849 - protein, 13 aa, synthetic construct
HSGSPHSKAQNQQ

SEQ ID NO: 1850 - protein, 13 aa, synthetic construct
GGGSPHSKALNQQ

SEQ ID NO: 1851 - protein, 13 aa, synthetic construct
GSGSPHSKALHQH

SEQ ID NO: 1852 - protein, 13 aa, synthetic construct
GTGSPHSKAQNHQ

SEQ ID NO: 1853 - protein, 13 aa, synthetic construct
GSGSPHSKAQHRI

SEQ ID NO: 1854 - protein, 13 aa, synthetic construct
GSGSPHSKAQYIH

SEQ ID NO: 1855 - protein, 13 aa, synthetic construct
GGGSPHSKAHNQQ

SEQ ID NO: 1856 - protein, 13 aa, synthetic construct
GSGSPHSKAQKFE

SEQ ID NO: 1857 - protein, 13 aa, synthetic construct
ESGSPHSKAQNHQ

SEQ ID NO: 1858 - protein, 13 aa, synthetic construct
GSGSPHSKAQFPS

SEQ ID NO: 1859 - protein, 13 aa, synthetic construct
PSGSPHSKAQNQQ

SEQ ID NO: 1860 - protein, 13 aa, synthetic construct
GNGSPHSKAQNPL

SEQ ID NO: 1861 - protein, 13 aa, synthetic construct
GGGSPHSKAQSQQ

SEQ ID NO: 1862 - protein, 13 aa, synthetic construct
GSGSPHSKAQAIK

SEQ ID NO: 1863 - protein, 13 aa, synthetic construct
GSGSPHSKGQNRQ

SEQ ID NO: 1864 - protein, 13 aa, synthetic construct
GSGSPHSKAQSQQ

SEQ ID NO: 1865 - protein, 13 aa, synthetic construct
GSVSPHGKAQNQL

SEQ ID NO: 1866 - protein, 13 aa, synthetic construct
ASGSPHSKAQNQL

SEQ ID NO: 1867 - protein, 13 aa, synthetic construct
RSGSPHSKAQNQQ

SEQ ID NO: 1868 - protein, 13 aa, synthetic construct
GSGSPHSKAQYQH

SEQ ID NO: 1869 - protein, 13 aa, synthetic construct
GSGSPHTKAQNPQ

SEQ ID NO: 1870 - protein, 13 aa, synthetic construct
GSGSPHSKGQNPP

SEQ ID NO: 1871 - protein, 13 aa, synthetic construct
GSGSPHSKAQHQL

SEQ ID NO: 1872 - protein, 13 aa, synthetic construct
GSGSPHSKAQSPP

SEQ ID NO: 1873 - protein, 13 aa, synthetic construct
GSGSPHSKAQAKL

SEQ ID NO: 1874 - protein, 13 aa, synthetic construct
GSGSPHSKTKSQQ

SEQ ID NO: 1875 - protein, 13 aa, synthetic construct
GSGSPHSKAQDRP

SEQ ID NO: 1876 - protein, 13 aa, synthetic construct
GIGSPHSKAQNLG

SEQ ID NO: 1877 - protein, 13 aa, synthetic construct
GSGSPHSKAQAFH

SEQ ID NO: 1878 - protein, 13 aa, synthetic construct
GSGSPHSKAQKQQ

SEQ ID NO: 1879 - protein, 13 aa, synthetic construct
GSGSPHSKAQNAQ

SEQ ID NO: 1880 - protein, 13 aa, synthetic construct
WSGSPHSKAQNQQ

SEQ ID NO: 1881 - protein, 13 aa, synthetic construct
GSGSPHSKAHNQL

SEQ ID NO: 1882 - protein, 13 aa, synthetic construct
GNGSPHSKAQNHQ

SEQ ID NO: 1883 - protein, 13 aa, synthetic construct
GGGSPHSKAQNLQ

SEQ ID NO: 1884 - protein, 13 aa, synthetic construct
GSGSPHSKAQKLN

SEQ ID NO: 1885 - protein, 13 aa, synthetic construct
GGGSPHSKSQNQH

SEQ ID NO: 1886 - protein, 13 aa, synthetic construct
GSGSPHSKSQNVQ

SEQ ID NO: 1887 - protein, 13 aa, synthetic construct
GSGSPHSKAQAQQ

SEQ ID NO: 1888 - protein, 13 aa, synthetic construct
DSGSPHSKAQNQQ

SEQ ID NO: 1889 - protein, 13 aa, synthetic construct
ASGSPHSKAPNQQ

SEQ ID NO: 1890 - protein, 13 aa, synthetic construct
GSGSPHSKAQTPP

SEQ ID NO: 1891 - protein, 13 aa, synthetic construct
IDGSPHSKAQNQQ

SEQ ID NO: 1892 - protein, 13 aa, synthetic construct
GSGSPHNKAQNHQ

SEQ ID NO: 1893 - protein, 13 aa, synthetic construct
GSGSPHSKAQPPA

SEQ ID NO: 1894 - protein, 13 aa, synthetic construct
GSGSPHSKAQERP

SEQ ID NO: 1895 - protein, 13 aa, synthetic construct
GSGSPHSKAQDLQ

SEQ ID NO: 1896 - protein, 13 aa, synthetic construct
GGGSPHSKAQNPP

SEQ ID NO: 1897 - protein, 13 aa, synthetic construct
GSGSPHSKAQAMH

SEQ ID NO: 1898 - protein, 13 aa, synthetic construct
GSGSPHSKALNQQ

SEQ ID NO: 1899 - protein, 13 aa, synthetic construct
GSGSPHSKAQHPS

SEQ ID NO: 1900 - protein, 13 aa, synthetic construct
GLGSPHSKSQNQQ

SEQ ID NO: 1901 - protein, 13 aa, synthetic construct
GTGSPHSKAQNQQ

SEQ ID NO: 1902 - protein, 13 aa, synthetic construct
GSGSPHSKAPGLQ

SEQ ID NO: 1903 - protein, 13 aa, synthetic construct
GSGSPHSKAQGIR

SEQ ID NO: 1904 - protein, 13 aa, synthetic construct
GSGSPHSKAQAPA

SEQ ID NO: 1905 - protein, 13 aa, synthetic construct
GSGSPHSKSQSQQ

SEQ ID NO: 1906 - protein, 13 aa, synthetic construct
GSGSPHSKAQIPP

SEQ ID NO: 1907 - protein, 13 aa, synthetic construct
GSGSPHSKAQTQL

SEQ ID NO: 1908 - protein, 13 aa, synthetic construct
GSGSPHSKAQAPS

SEQ ID NO: 1909 - protein, 13 aa, synthetic construct
DAGSPHSKAQNQQ

SEQ ID NO: 1910 - protein, 13 aa, synthetic construct
GSGSPHSKGQNQQ

SEQ ID NO: 1911 - protein, 13 aa, synthetic construct
DGGSPHSKAQNQQ

SEQ ID NO: 1912 - protein, 13 aa, synthetic construct
ASGSPHSKAHNQQ

SEQ ID NO: 1913 - protein, 13 aa, synthetic construct
GSGSPHSKAQNTY

SEQ ID NO: 1914 - protein, 13 aa, synthetic construct
GSGSPHSKSQNQH

SEQ ID NO: 1915 - protein, 13 aa, synthetic construct
GGGSPHSKAQDKQ

SEQ ID NO: 1916 - protein, 13 aa, synthetic construct
GSGSPHSKAQNHL

SEQ ID NO: 1917 - protein, 13 aa, synthetic construct
GSGSPHSKAQIGM

SEQ ID NO: 1918 - protein, 13 aa, synthetic construct
GSGSPHSKALNKQ

SEQ ID NO: 1919 - protein, 13 aa, synthetic construct
GGGSPHSKAQNPQ

SEQ ID NO: 1920 - protein, 13 aa, synthetic construct
GTGSPHSKAPNQL

SEQ ID NO: 1921 - protein, 13 aa, synthetic construct
GSGSPHSKAQLQQ

SEQ ID NO: 1922 - protein, 13 aa, synthetic construct
GGGSPHSKAQYQQ

SEQ ID NO: 1923 - protein, 13 aa, synthetic construct
GGGSPHSKAQHQQ

SEQ ID NO: 1924 - protein, 13 aa, synthetic construct
GSGSPHSKAQRMS

SEQ ID NO: 1925 - protein, 13 aa, synthetic construct
GSGSPHSKAQGIL

SEQ ID NO: 1926 - protein, 13 aa, synthetic construct
GSGSPHSKAQDRQ

SEQ ID NO: 1927 - protein, 13 aa, synthetic construct
GSGSPHSKARDWQ

SEQ ID NO: 1928 - protein, 13 aa, synthetic construct
GSGSPHSKAQNTH

SEQ ID NO: 1929 - protein, 13 aa, synthetic construct
GSGSPHSKAQERS

SEQ ID NO: 1930 - protein, 13 aa, synthetic construct
GSGSPHSKAQNYQ

SEQ ID NO: 1931 - protein, 13 aa, synthetic construct
GSGSPHSKAQRTC

SEQ ID NO: 1932 - protein, 13 aa, synthetic construct
GSGSPHSKAQIGH

SEQ ID NO: 1933 - protein, 13 aa, synthetic construct
GSGSPHSKAQGAI

SEQ ID NO: 1934 - protein, 13 aa, synthetic construct
GSGSPHSKAQVPP

SEQ ID NO: 1935 - protein, 13 aa, synthetic construct
GSGSPHSKAQVQQ

SEQ ID NO: 1936 - protein, 13 aa, synthetic construct
GSGSPHSKALMRQ

SEQ ID NO: 1937 - protein, 13 aa, synthetic construct
GSGSPHSKAQYSV

SEQ ID NO: 1938 - protein, 13 aa, synthetic construct
GSGSPHSKVPNLQ

SEQ ID NO: 1939 - protein, 13 aa, synthetic construct
GSGSPHSKAQAIT

SEQ ID NO: 1940 - protein, 13 aa, synthetic construct
GSGSPHSKAQKTL

SEQ ID NO: 1941 - protein, 13 aa, synthetic construct
GSGSPHSKAQNQW

SEQ ID NO: 1942 - protein, 13 aa, synthetic construct
GSGSPHSKAQLHH

SEQ ID NO: 1943 - protein, 13 aa, synthetic construct
GSGSPHSKAQNII

SEQ ID NO: 1944 - protein, 13 aa, synthetic construct
MEGSPHSKAQNQQ

SEQ ID NO: 1945 - protein, 13 aa, synthetic construct
GSGSPHSKAQGHH

SEQ ID NO: 1946 - protein, 13 aa, synthetic construct
GSGSPHSKAQSKV

SEQ ID NO: 1947 - protein, 13 aa, synthetic construct
GSGSPHSKAQLPS

SEQ ID NO: 1948 - protein, 13 aa, synthetic construct
GSGSPHSKAIGKQ

SEQ ID NO: 1949 - protein, 13 aa, synthetic construct
GGGSPHSKSQNQQ

SEQ ID NO: 1950 - protein, 13 aa, synthetic construct
GSGSPHSKAQAIH

SEQ ID NO: 1951 - protein, 13 aa, synthetic construct
GSGSPHSKAQHGL

SEQ ID NO: 1952 - protein, 13 aa, synthetic construct
GSGSPHSKAQFMC

SEQ ID NO: 1953 - protein, 13 aa, synthetic construct
VSGSPHSKAQGQQ

SEQ ID NO: 1954 - protein, 13 aa, synthetic construct
GGGSPHSKAQNQM

SEQ ID NO: 1955 - protein, 13 aa, synthetic construct
GSGSPHSKAQHLQ

SEQ ID NO: 1956 - protein, 13 aa, synthetic construct
ENGSPHSKAQNQQ

SEQ ID NO: 1957 - protein, 13 aa, synthetic construct
GSGSPHSKTQNHQ

SEQ ID NO: 1958 - protein, 13 aa, synthetic construct
GSGSPHSKAQPAR

SEQ ID NO: 1959 - protein, 13 aa, synthetic construct
GSGSPHSKAQSLQ

SEQ ID NO: 1960 - protein, 13 aa, synthetic construct
GSGSPHSKSQSQL

SEQ ID NO: 1961 - protein, 13 aa, synthetic construct
GSASPHSKAHSQQ

SEQ ID NO: 1962 - protein, 13 aa, synthetic construct
GSGSPHSKAQMPS

SEQ ID NO: 1963 - protein, 13 aa, synthetic construct
GSGSPHSKAQGSL

SEQ ID NO: 1964 - protein, 13 aa, synthetic construct
GSGSPHSKSQNQQ

SEQ ID NO: 1965 - protein, 13 aa, synthetic construct
GNGSPHSKSQNQQ

SEQ ID NO: 1966 - protein, 13 aa, synthetic construct
GSGSPHSKAQVPA

SEQ ID NO: 1967 - protein, 13 aa, synthetic construct
GNGSPHSKAQNLQ

SEQ ID NO: 1968 - protein, 13 aa, synthetic construct
GSGSPHSKAQDKQ

SEQ ID NO: 1969 - protein, 13 aa, synthetic construct
GSGSPHSKAHYQQ

SEQ ID NO: 1970 - protein, 13 aa, synthetic construct
GSGSPHSKAQVPS

SEQ ID NO: 1971 - protein, 13 aa, synthetic construct
GGGSPHSKAQNHQ

SEQ ID NO: 1972 - protein, 13 aa, synthetic construct
GSGSPHSKARGEQ

SEQ ID NO: 1973 - protein, 13 aa, synthetic construct
GGGSPHSKAQYQH

SEQ ID NO: 1974 - protein, 13 aa, synthetic construct
GSGSPHSKAPGQQ

SEQ ID NO: 1975 - protein, 13 aa, synthetic construct
KNGSPHSKAQNQQ

SEQ ID NO: 1976 - protein, 13 aa, synthetic construct
GSGSPHSKRLEQQ

SEQ ID NO: 1977 - protein, 13 aa, synthetic construct
GSGSPHSKAQNQS

SEQ ID NO: 1978 - protein, 13 aa, synthetic construct
GSGSPHSKAQKVI

SEQ ID NO: 1979 - protein, 13 aa, synthetic construct
GSGSPHSKAQNND

SEQ ID NO: 1980 - protein, 13 aa, synthetic construct
GSGSPHSKAQSVH

SEQ ID NO: 1981 - protein, 13 aa, synthetic construct
GSGSPHSKAQPLG

SEQ ID NO: 1982 - protein, 13 aa, synthetic construct
KEGSPHSKAQNQQ

SEQ ID NO: 1983 - protein, 13 aa, synthetic construct
GSGSPHSKAHNQE

SEQ ID NO: 1984 - protein, 13 aa, synthetic construct
GSGSPHSKAQIQQ

SEQ ID NO: 1985 - protein, 13 aa, synthetic construct
GSGSPHSKAQVRN

SEQ ID NO: 1986 - protein, 13 aa, synthetic construct
GSGSPHSKAPSNQ

SEQ ID NO: 1987 - protein, 13 aa, synthetic construct
GSGSPHSKAQVGH

SEQ ID NO: 1988 - protein, 13 aa, synthetic construct
GSGSPHSKAQRDI

SEQ ID NO: 1989 - protein, 13 aa, synthetic construct
GSGSPHSKAQMPN

SEQ ID NO: 1990 - protein, 13 aa, synthetic construct
AIGSPHSKAQNQQ

SEQ ID NO: 1991 - protein, 13 aa, synthetic construct
GSGSPHSKARGLQ

SEQ ID NO: 1992 - protein, 13 aa, synthetic construct
GSGSPHSKLQKQQ

SEQ ID NO: 1993 - protein, 13 aa, synthetic construct
GSGSPHSKAPSLQ

SEQ ID NO: 1994 - protein, 13 aa, synthetic construct
GSGSPHSKAQRDQ

SEQ ID NO: 1995 - protein, 13 aa, synthetic construct
GSGSPHSKNRDQQ

SEQ ID NO: 1996 - protein, 13 aa, synthetic construct
GSGSPHSKAQAKG

SEQ ID NO: 1997 - protein, 13 aa, synthetic construct
GSGSPHSKAQSAH

SEQ ID NO: 1998 - protein, 13 aa, synthetic construct
GNGSPHSKSQNQH

SEQ ID NO: 1999 - protein, 13 aa, synthetic construct
GSGSPHSKSQNHQ

SEQ ID NO: 2000 - protein, 13 aa, synthetic construct
RSGSPHSKAQDQQ

SEQ ID NO: 2001 - protein, 13 aa, synthetic construct
GSGSPHSKAQSTM

SEQ ID NO: 2002 - protein, 13 aa, synthetic construct
GSGSPHSKAQREM

SEQ ID NO: 2003 - protein, 13 aa, synthetic construct
GGGSPHSKSQNRQ

SEQ ID NO: 2004 - protein, 13 aa, synthetic construct
GSGSPHSKAQYRA

SEQ ID NO: 2005 - protein, 13 aa, synthetic construct
GGGSPHSKAQRQQ

SEQ ID NO: 2006 - protein, 13 aa, synthetic construct
GSGSPHSKNQWQQ

SEQ ID NO: 2007 - protein, 13 aa, synthetic construct
GSGSPHSKAQRMN

SEQ ID NO: 2008 - protein, 13 aa, synthetic construct
GSGSPHAKAQNHQ

SEQ ID NO: 2009 - protein, 13 aa, synthetic construct
GSGSPHSKAGDSQ

SEQ ID NO: 2010 - protein, 13 aa, synthetic construct
GSGSPHSKLKSQQ

SEQ ID NO: 2011 - protein, 13 aa, synthetic construct
GSGSPHSKAQKIS

SEQ ID NO: 2012 - protein, 13 aa, synthetic construct
GSGSPHSKAPSMQ

SEQ ID NO: 2013 - protein, 13 aa, synthetic construct
GSGSPHSKASPRQ

SEQ ID NO: 2014 - protein, 13 aa, synthetic construct
GSGSPHSKRMEQQ

SEQ ID NO: 2015 - protein, 13 aa, synthetic construct
GSGSPHSKAQYQN

SEQ ID NO: 2016 - protein, 13 aa, synthetic construct
GSGSPHARMQNQQ

SEQ ID NO: 2017 - protein, 13 aa, synthetic construct
GSGSPHVKSQNQQ

SEQ ID NO: 2018 - protein, 13 aa, synthetic construct
GQDSPHKSGQNQQ

SEQ ID NO: 2019 - protein, 13 aa, synthetic construct
GSGSPHASRQNQQ

SEQ ID NO: 2020 - protein, 13 aa, synthetic construct
GSGSPHASRQNKQ

SEQ ID NO: 2021 - protein, 13 aa, synthetic construct
GSGSPHVKIQNQQ

SEQ ID NO: 2022 - protein, 13 aa, synthetic construct
GSGSPHSKAKNQQ

SEQ ID NO: 2023 - protein, 13 aa, synthetic construct
GSGSPHKKNQNQQ

SEQ ID NO: 2024 - protein, 13 aa, synthetic construct
GSGSPHVRMQNQQ

SEQ ID NO: 2025 - protein, 13 aa, synthetic construct
GSGSPHASRQKQQ

SEQ ID NO: 2026 - protein, 13 aa, synthetic construct
GHSSPHRSGQNQQ

SEQ ID NO: 2027 - protein, 13 aa, synthetic construct
GSGSPHTRGQNQQ

SEQ ID NO: 2028 - protein, 13 aa, synthetic construct
CSGSPHSKAQNQQ

SEQ ID NO: 2029 - protein, 13 aa, synthetic construct
GSGSPHRKAQNQQ

SEQ ID NO: 2030 - protein, 13 aa, synthetic construct
GSGSPHSKAQNKQ

SEQ ID NO: 2031 - protein, 13 aa, synthetic construct
GSGSPHSKAQTQQ

SEQ ID NO: 2032 - protein, 13 aa, synthetic construct
CSGSPHKTSQNQQ

SEQ ID NO: 2033 - protein, 13 aa, synthetic construct
CSHSPHKSGQNQQ

SEQ ID NO: 2034 - protein, 13 aa, synthetic construct
GQSSPHRSGQNQQ

SEQ ID NO: 2035 - protein, 13 aa, synthetic construct
GRGSPHASRQNQQ

SEQ ID NO: 2036 - protein, 13 aa, synthetic construct
GSGSPHASRKNQQ

SEQ ID NO: 2037 - protein, 13 aa, synthetic construct
GSGSPHASRQNQH

SEQ ID NO: 2038 - protein, 13 aa, synthetic construct
GSGSPHKFGKNQQ

SEQ ID NO: 2039 - protein, 13 aa, synthetic construct
GSGSPHKFGQKQQ

SEQ ID NO: 2040 - protein, 13 aa, synthetic construct
GSGSPHKFGQNQQ

SEQ ID NO: 2041 - protein, 13 aa, synthetic construct
GSGSPHKIGQNQQ

SEQ ID NO: 2042 - protein, 13 aa, synthetic construct
GSGSPHKLGQNQQ

SEQ ID NO: 2043 - protein, 13 aa, synthetic construct
GSGSPHKTSKNQQ

SEQ ID NO: 2044 - protein, 13 aa, synthetic construct
GSGSPHKTSQKQQ

SEQ ID NO: 2045 - protein, 13 aa, synthetic construct
GSGSPHKTSQNQQ

SEQ ID NO: 2046 - protein, 13 aa, synthetic construct
GSGSPHKTTQNQQ

SEQ ID NO: 2047 - protein, 13 aa, synthetic construct
GSGSPHKTYQNQQ

SEQ ID NO: 2048 - protein, 13 aa, synthetic construct
GSGSPHKYGQNQQ

SEQ ID NO: 2049 - protein, 13 aa, synthetic construct
GSGSPHSKAQHQQ

SEQ ID NO: 2050 - protein, 13 aa, synthetic construct
GSGSPHSKDQNQQ

SEQ ID NO: 2051 - protein, 13 aa, synthetic construct
GSGSPHSKPQNQQ

SEQ ID NO: 2052 - protein, 13 aa, synthetic construct
GSGSPHVRGQKQQ

SEQ ID NO: 2053 - protein, 13 aa, synthetic construct
GSGSPHVRGQNKQ

SEQ ID NO: 2054 - protein, 13 aa, synthetic construct
GSHSPHKRGQNQQ

SEQ ID NO: 2055 - protein, 13 aa, synthetic construct
GSHSPHKSGQKQQ

SEQ ID NO: 2056 - protein, 13 aa, synthetic construct
GSHSPHKSGQNQQ

SEQ ID NO: 2057 - protein, 13 aa, synthetic construct
VSGSPHASRQNQQ

SEQ ID NO: 2058 - protein, 13 aa, synthetic construct
VSGSPHGARQNQQ

SEQ ID NO: 2059 - protein, 13 aa, synthetic construct
VSGSPHKFGQNQQ

SEQ ID NO: 2060 - protein, 13 aa, synthetic construct
GSGSPHSKAQYYV

SEQ ID NO: 2061 - protein, 13 aa, synthetic construct
GSGSPHSKLRRQQ

SEQ ID NO: 2062 - protein, 13 aa, synthetic construct
GSGSPHSKAGCGQ

SEQ ID NO: 2063 - protein, 13 aa, synthetic construct
GSGSPHSRAQNQQ

SEQ ID NO: 2064 - protein, 13 aa, synthetic construct
GSGSPHSKRLRQQ

SEQ ID NO: 2065 - protein, 13 aa, synthetic construct
GSGSPHSLRRNQQ

SEQ ID NO: 2066 - protein, 13 aa, synthetic construct
GSGSPHSRGRNQQ

SEQ ID NO: 2067 - protein, 13 aa, synthetic construct
GSGSPHSSRRNQQ

SEQ ID NO: 2068 - protein, 13 aa, synthetic construct
GSGSPHSKAFRLQ

SEQ ID NO: 2069 - protein, 13 aa, synthetic construct
GSCSPHRKAQNQQ

SEQ ID NO: 2070 - protein, 13 aa, synthetic construct
GSGSPHFLRQNQQ

SEQ ID NO: 2071 - protein, 13 aa, synthetic construct
GSGSPHSLRFNQQ

SEQ ID NO: 2072 - protein, 13 aa, synthetic construct
GSGSPHSKWLLQQ

SEQ ID NO: 2073 - protein, 13 aa, synthetic construct
GSGSPHSKRRLQQ

SEQ ID NO: 2074 - protein, 13 aa, synthetic construct
GSGSPHSKAQRKL

SEQ ID NO: 2075 - protein, 13 aa, synthetic construct
GSGSPHSKALRRQ

SEQ ID NO: 2076 - protein, 13 aa, synthetic construct
GSGSPHSKAQRLR

SEQ ID NO: 2077 - protein, 13 aa, synthetic construct
GSGSPHSKAQRRL

SEQ ID NO: 2078 - protein, 13 aa, synthetic construct
GSGSPHSKARRQQ

SEQ ID NO: 2079 - protein, 13 aa, synthetic construct
GSGSPHSKARRLQ

SEQ ID NO: 2080 - protein, 13 aa, synthetic construct
GSGSPHSKSRRQQ

SEQ ID NO: 2081 - protein, 13 aa, synthetic construct
GLLSPHWKAQNQQ

SEQ ID NO: 2082 - protein, 13 aa, synthetic construct
GSGSPHSKARLRQ

SEQ ID NO: 2083 - protein, 13 aa, synthetic construct
GSGSPHSKASKRQ

SEQ ID NO: 2084 - protein, 13 aa, synthetic construct
GSGSPHVRRQNQQ

SEQ ID NO: 2085 - protein, 13 aa, synthetic construct
GSGSPHSKAQLYR

SEQ ID NO: 2086 - protein, 13 aa, synthetic construct
GSGSPHSKAQLTV

SEQ ID NO: 2087 - protein, 13 aa, synthetic construct
GHDSPHKRGQHRQ

SEQ ID NO: 2088 - protein, 13 aa, synthetic construct
GHDSPHKSGQKQQ

SEQ ID NO: 2089 - protein, 13 aa, synthetic construct
GHDSPHKSGLTQQ

SEQ ID NO: 2090 - protein, 13 aa, synthetic construct
GDDSPHKSGRNQQ

SEQ ID NO: 2091 - protein, 13 aa, synthetic construct
GHDSPHKSGLNQQ

SEQ ID NO: 2092 - protein, 13 aa, synthetic construct
GHESPHKSAQNHQ

SEQ ID NO: 2093 - protein, 13 aa, synthetic construct
GHDSPHKSAQNQW

SEQ ID NO: 2094 - protein, 13 aa, synthetic construct
GHDSPHKSGQNTH

SEQ ID NO: 2095 - protein, 13 aa, synthetic construct
GHDSPHKSGRRRQ

SEQ ID NO: 2096 - protein, 13 aa, synthetic construct
GHDSPHKSAQNQQ

SEQ ID NO: 2097 - protein, 13 aa, synthetic construct
GHDSPHKSGQYQQ

SEQ ID NO: 2098 - protein, 13 aa, synthetic construct
GNYSPHKIGQNQQ

SEQ ID NO: 2099 - protein, 13 aa, synthetic construct
GHDSPHKSRQNDQ

SEQ ID NO: 2100 - protein, 13 aa, synthetic construct
GHDSPHKSGQIRQ

SEQ ID NO: 2101 - protein, 13 aa, synthetic construct
GHDSPHKIGQNQH

SEQ ID NO: 2102 - protein, 13 aa, synthetic construct
GYDSPHKSGQKQQ

SEQ ID NO: 2103 - protein, 13 aa, synthetic construct
GHDSPHKSGQSVQ

SEQ ID NO: 2104 - protein, 13 aa, synthetic construct
GHESPHKSGRSQQ

SEQ ID NO: 2105 - protein, 13 aa, synthetic construct
GHDSPHKSGQNKL

SEQ ID NO: 2106 - protein, 13 aa, synthetic construct
GHDSPHKTGQNQQ

SEQ ID NO: 2107 - protein, 13 aa, synthetic construct
GRGSPHKRGQNQQ

SEQ ID NO: 2108 - protein, 13 aa, synthetic construct
GSGSPHTKAQNPP

SEQ ID NO: 2109 - protein, 13 aa, synthetic construct
GQDSPHKSGQHQQ

SEQ ID NO: 2110 - protein, 13 aa, synthetic construct
GHDSPHKSGQIQH

SEQ ID NO: 2111 - protein, 13 aa, synthetic construct
GHDSPHKSGPRQQ

SEQ ID NO: 2112 - protein, 13 aa, synthetic construct
GHDSPHKSGHTQQ

SEQ ID NO: 2113 - protein, 13 aa, synthetic construct
GHDSPHKSGQRQH

SEQ ID NO: 2114 - protein, 13 aa, synthetic construct
GSGSPHTKAQNQQ

SEQ ID NO: 2115 - protein, 13 aa, synthetic construct
GHDSPHKSAQSQQ

SEQ ID NO: 2116 - protein, 13 aa, synthetic construct
GHESPHKSGQNQQ

SEQ ID NO: 2117 - protein, 13 aa, synthetic construct
GHDSPHKSLQNQQ

SEQ ID NO: 2118 - protein, 13 aa, synthetic construct
GHGSPHSKAQNPQ

SEQ ID NO: 2119 - protein, 13 aa, synthetic construct
GHDSPHKSGRNQE

SEQ ID NO: 2120 - protein, 13 aa, synthetic construct
GHDSPHKSGQTQL

SEQ ID NO: 2121 - protein, 13 aa, synthetic construct
GHDSPHKSEKNQQ

SEQ ID NO: 2122 - protein, 13 aa, synthetic construct
GRDSPHKSGQDQQ

SEQ ID NO: 2123 - protein, 13 aa, synthetic construct
GHDSPHKTGHNQQ

SEQ ID NO: 2124 - protein, 13 aa, synthetic construct
GYDSPHKSGQTQQ

SEQ ID NO: 2125 - protein, 13 aa, synthetic construct
GHESPHKSGQTQQ

SEQ ID NO: 2126 - protein, 13 aa, synthetic construct
GHDSPHKSGQSKQ

SEQ ID NO: 2127 - protein, 13 aa, synthetic construct
GHDSPHKTGQNQP

SEQ ID NO: 2128 - protein, 13 aa, synthetic construct
GHDSPHKSGQSPQ

SEQ ID NO: 2129 - protein, 13 aa, synthetic construct
GNDSPHKSVQNQQ

SEQ ID NO: 2130 - protein, 13 aa, synthetic construct
GHDSPHKSAQNYQ

SEQ ID NO: 2131 - protein, 13 aa, synthetic construct
GSASPHSKALNQQ

SEQ ID NO: 2132 - protein, 13 aa, synthetic construct
GHESPHKSAQNRQ

SEQ ID NO: 2133 - protein, 13 aa, synthetic construct
GQDSPHKIGQNQQ

SEQ ID NO: 2134 - protein, 13 aa, synthetic construct
GHDSPHKSGQNHL

SEQ ID NO: 2135 - protein, 13 aa, synthetic construct
GHDSPHKSGQYQH

SEQ ID NO: 2136 - protein, 13 aa, synthetic construct
GNDSPHKSVQNHQ

SEQ ID NO: 2137 - protein, 13 aa, synthetic construct
GHDSPHKSGQNQW

SEQ ID NO: 2138 - protein, 13 aa, synthetic construct
GHDSPHKSVQNQH

SEQ ID NO: 2139 - protein, 13 aa, synthetic construct
GHDSPHKSGQNQH

SEQ ID NO: 2140 - protein, 13 aa, synthetic construct
GHDSPHKSGQTRQ

SEQ ID NO: 2141 - protein, 13 aa, synthetic construct
GHDSPHKSGQNLH

SEQ ID NO: 2142 - protein, 13 aa, synthetic construct
GHDSPHKSAQNQE

SEQ ID NO: 2143 - protein, 13 aa, synthetic construct
GHDSPHKSGQHLQ

SEQ ID NO: 2144 - protein, 13 aa, synthetic construct
GHDSPHKSRLNQP

SEQ ID NO: 2145 - protein, 13 aa, synthetic construct
GQDSPHKSGQNQD

SEQ ID NO: 2146 - protein, 13 aa, synthetic construct
GHDSPHKSGRNQQ

SEQ ID NO: 2147 - protein, 13 aa, synthetic construct
GHDSPHKSGQNLL

SEQ ID NO: 2148 - protein, 13 aa, synthetic construct
GHDSPHKSGQLVI

SEQ ID NO: 2149 - protein, 13 aa, synthetic construct
GHDSPHKSRQSQQ

SEQ ID NO: 2150 - protein, 13 aa, synthetic construct
GHDSPHKSGRTQE

SEQ ID NO: 2151 - protein, 13 aa, synthetic construct
GHDSPHKSVQTHQ

SEQ ID NO: 2152 - protein, 13 aa, synthetic construct
GHDSPHKSGQNQP

SEQ ID NO: 2153 - protein, 13 aa, synthetic construct
GHDSPHKSGQTQQ

SEQ ID NO: 2154 - protein, 13 aa, synthetic construct
GPDSPHKIGQNQQ

SEQ ID NO: 2155 - protein, 13 aa, synthetic construct
GHDSPHKSVQNQQ

SEQ ID NO: 2156 - protein, 13 aa, synthetic construct
GHDSPHKSRQDQH

SEQ ID NO: 2157 - protein, 13 aa, synthetic construct
GPDSPHKSGQKQQ

SEQ ID NO: 2158 - protein, 13 aa, synthetic construct
GHDSPHKSRQSQH

SEQ ID NO: 2159 - protein, 13 aa, synthetic construct
GHDSPHKSVQNQL

SEQ ID NO: 2160 - protein, 13 aa, synthetic construct
GYDSPHKSGQYQH

SEQ ID NO: 2161 - protein, 13 aa, synthetic construct
GHDSPHKSRQNQQ

SEQ ID NO: 2162 - protein, 13 aa, synthetic construct
GHDSPHKSWVRQQ

SEQ ID NO: 2163 - protein, 13 aa, synthetic construct
GHESPHKSGQNQH

SEQ ID NO: 2164 - protein, 13 aa, synthetic construct
GHDSPHKIGHNQQ

SEQ ID NO: 2165 - protein, 13 aa, synthetic construct
GHDSPHKSNAWQQ

SEQ ID NO: 2166 - protein, 13 aa, synthetic construct
GHDSPHKSGQSVP

SEQ ID NO: 2167 - protein, 13 aa, synthetic construct
GHESPHKSGQNIQ

SEQ ID NO: 2168 - protein, 13 aa, synthetic construct
GHDSPHKSVQNHL

SEQ ID NO: 2169 - protein, 13 aa, synthetic construct
GHDSPHKIGLDQQ

SEQ ID NO: 2170 - protein, 13 aa, synthetic construct
ASGSPHSKAQHQQ

SEQ ID NO: 2171 - protein, 13 aa, synthetic construct
GHDSPHKRGPDQQ

SEQ ID NO: 2172 - protein, 13 aa, synthetic construct
GMGSPHSKTQNQQ

SEQ ID NO: 2173 - protein, 13 aa, synthetic construct
GHDSPHKSGESQQ

SEQ ID NO: 2174 - protein, 13 aa, synthetic construct
GHDSPHKHGQNHQ

SEQ ID NO: 2175 - protein, 13 aa, synthetic construct
GTGSPHSKAQNQL

SEQ ID NO: 2176 - protein, 13 aa, synthetic construct
GHDSPHKSVQNKQ

SEQ ID NO: 2177 - protein, 13 aa, synthetic construct
GQVSPHKSGQNQQ

SEQ ID NO: 2178 - protein, 13 aa, synthetic construct
GHDSPHKSGQRQL

SEQ ID NO: 2179 - protein, 13 aa, synthetic construct
GHDSPHKIGQNQL

SEQ ID NO: 2180 - protein, 13 aa, synthetic construct
GHDSPHKSGQIIV

SEQ ID NO: 2181 - protein, 13 aa, synthetic construct
GYDSPHKSGQKQS

SEQ ID NO: 2182 - protein, 13 aa, synthetic construct
GNGSPHSKAQNQE

SEQ ID NO: 2183 - protein, 13 aa, synthetic construct
GDDSPHKSVQNQQ

SEQ ID NO: 2184 - protein, 13 aa, synthetic construct
GHDSPHKSVQSHQ

SEQ ID NO: 2185 - protein, 13 aa, synthetic construct
GHDSPHKSGQFVV

SEQ ID NO: 2186 - protein, 13 aa, synthetic construct
GHDSPHKSRQNLQ

SEQ ID NO: 2187 - protein, 13 aa, synthetic construct
GHNSPHKSGQNQE

SEQ ID NO: 2188 - protein, 13 aa, synthetic construct
GHDSPHKSGQSQP

SEQ ID NO: 2189 - protein, 13 aa, synthetic construct
GHESPHKSGQNEQ

SEQ ID NO: 2190 - protein, 13 aa, synthetic construct
GHDSPHKSGQNQL

SEQ ID NO: 2191 - protein, 13 aa, synthetic construct
GHDSPHKSAQNLL

SEQ ID NO: 2192 - protein, 13 aa, synthetic construct
ASGSPHSKAINQQ

SEQ ID NO: 2193 - protein, 13 aa, synthetic construct
GNGSPHKRGQNQQ

SEQ ID NO: 2194 - protein, 13 aa, synthetic construct
GHDSPHKSGQSLQ

SEQ ID NO: 2195 - protein, 13 aa, synthetic construct
GHDSPHKSAQNHQ

SEQ ID NO: 2196 - protein, 13 aa, synthetic construct
GHDSPHKSGRNRQ

SEQ ID NO: 2197 - protein, 13 aa, synthetic construct
GHDSPHKYGQNEQ

SEQ ID NO: 2198 - protein, 13 aa, synthetic construct
GNGSPHSKAPNLQ

SEQ ID NO: 2199 - protein, 13 aa, synthetic construct
GHDSPHKSQQNQQ

SEQ ID NO: 2200 - protein, 13 aa, synthetic construct
GHDSPHKSVQSKQ

SEQ ID NO: 2201 - protein, 13 aa, synthetic construct
GNDSPHKIGHNQQ

SEQ ID NO: 2202 - protein, 13 aa, synthetic construct
GGGSPHSKAQDQQ

SEQ ID NO: 2203 - protein, 13 aa, synthetic construct
GQDSPHKSGQNPL

SEQ ID NO: 2204 - protein, 13 aa, synthetic construct
ASGSPHSKAQNHQ

SEQ ID NO: 2205 - protein, 13 aa, synthetic construct
GHDSPHKSGRDQK

SEQ ID NO: 2206 - protein, 13 aa, synthetic construct
GHDSPHKSVHNQQ

SEQ ID NO: 2207 - protein, 13 aa, synthetic construct
GHDSPHKSGQWKR

SEQ ID NO: 2208 - protein, 13 aa, synthetic construct
GSGSPHSKAENRQ

SEQ ID NO: 2209 - protein, 13 aa, synthetic construct
GHDSPHKSGQSQQ

SEQ ID NO: 2210 - protein, 13 aa, synthetic construct
GHDSPHKSRQAQQ

SEQ ID NO: 2211 - protein, 13 aa, synthetic construct
GHDSPHKSVQNHQ

SEQ ID NO: 2212 - protein, 13 aa, synthetic construct
GHDSPHKSKQNQQ

SEQ ID NO: 2213 - protein, 13 aa, synthetic construct
GHDSPHKSAQNQL

SEQ ID NO: 2214 - protein, 13 aa, synthetic construct
GHDSPHKSGQTQP

SEQ ID NO: 2215 - protein, 13 aa, synthetic construct
GHDSPHKLWINQQ

SEQ ID NO: 2216 - protein, 13 aa, synthetic construct
GPDSPHKSGQNQQ

SEQ ID NO: 2217 - protein, 13 aa, synthetic construct
GHDSPHKSVQKQL

SEQ ID NO: 2218 - protein, 13 aa, synthetic construct
GHPSPHWKGQNQQ

SEQ ID NO: 2219 - protein, 13 aa, synthetic construct
GHDSPHKSGRNQL

SEQ ID NO: 2220 - protein, 13 aa, synthetic construct
GSGSPHSKVQDQQ

SEQ ID NO: 2221 - protein, 13 aa, synthetic construct
GHDSPHKMGRNQQ

SEQ ID NO: 2222 - protein, 13 aa, synthetic construct
GHDSPHKSGISIQ

SEQ ID NO: 2223 - protein, 13 aa, synthetic construct
GHDSPHKSVQNLQ

SEQ ID NO: 2224 - protein, 13 aa, synthetic construct
GHDSPHKMAHNQQ

SEQ ID NO: 2225 - protein, 13 aa, synthetic construct
GHDSPHKHGQNQQ

SEQ ID NO: 2226 - protein, 13 aa, synthetic construct
GHDSPHKSVQSQQ

SEQ ID NO: 2227 - protein, 13 aa, synthetic construct
GHDSPHKSGQTVC

SEQ ID NO: 2228 - protein, 13 aa, synthetic construct
GQDSPHKSGQYQQ

SEQ ID NO: 2229 - protein, 13 aa, synthetic construct
GHDSPHKSGQQIM

SEQ ID NO: 2230 - protein, 13 aa, synthetic construct
GHDSPHKSRQNEQ

SEQ ID NO: 2231 - protein, 13 aa, synthetic construct
GHDSPHKSGLNHQ

SEQ ID NO: 2232 - protein, 13 aa, synthetic construct
GYDSPHKSGQNQQ

SEQ ID NO: 2233 - protein, 13 aa, synthetic construct
GHDSPHKSGQNLQ

SEQ ID NO: 2234 - protein, 13 aa, synthetic construct
GHDSPHKSRQDQQ

SEQ ID NO: 2235 - protein, 13 aa, synthetic construct
GDDSPHKSGQKQL

SEQ ID NO: 2236 - protein, 13 aa, synthetic construct
GSGSPHSKAQNQA

SEQ ID NO: 2237 - protein, 13 aa, synthetic construct
GDDSPHKSGHNQQ

SEQ ID NO: 2238 - protein, 13 aa, synthetic construct
GHDSPHKSGQMIH

SEQ ID NO: 2239 - protein, 13 aa, synthetic construct
GHDSPHKSGRNHQ

SEQ ID NO: 2240 - protein, 13 aa, synthetic construct
GHDSPHKSVQNRQ

SEQ ID NO: 2241 - protein, 13 aa, synthetic construct
GHDSPHKSGQKMN

SEQ ID NO: 2242 - protein, 16 aa, synthetic construct
TINGSGSPHSKAQNQQ

SEQ ID NO: 2243 - protein, 16 aa, synthetic construct
TINGHDSPHKSGQNQQ

SEQ ID NO: 2244 - protein, 16 aa, synthetic construct
TIIGSGSPHSKAQNRH

SEQ ID NO: 2245 - protein, 16 aa, synthetic construct
TFPGSGSPHSKVQNQQ

SEQ ID NO: 2246 - protein, 16 aa, synthetic construct
TEKMSGSPHSKAQNQQ

SEQ ID NO: 2247 - protein, 16 aa, synthetic construct
EINGRGSPHSKAQNQQ

SEQ ID NO: 2248 - protein, 16 aa, synthetic construct
TVNRNGSPHSKAQNQQ

SEQ ID NO: 2249 - protein, 16 aa, synthetic construct
TVNGSGSPHSKARDQQ

SEQ ID NO: 2250 - protein, 16 aa, synthetic construct
TFNGSGSPHSKAPNLQ

SEQ ID NO: 2251 - protein, 16 aa, synthetic construct
TEKTSGSPHSKAQNQQ

SEQ ID NO: 2252 - protein, 16 aa, synthetic construct
TINGSGSPHSKAHVRQ

SEQ ID NO: 2253 - protein, 16 aa, synthetic construct
TVNGSGSPHSKAPNQH

SEQ ID NO: 2254 - protein, 16 aa, synthetic construct
TEKISGSPHSKAQNQQ

SEQ ID NO: 2255 - protein, 16 aa, synthetic construct
TINGPGSPHSKAHNQQ

SEQ ID NO: 2256 - protein, 16 aa, synthetic construct
TVNGSGSPHSKTQSQQ

SEQ ID NO: 2257 - protein, 16 aa, synthetic construct
SINESGSPHSKAQNQQ

SEQ ID NO: 2258 - protein, 16 aa, synthetic construct
TERTSGSPHSKAQNQQ

SEQ ID NO: 2259 - protein, 16 aa, synthetic construct
TINGSGSPHSKAQPAK

SEQ ID NO: 2260 - protein, 16 aa, synthetic construct
TEKSSGSPHSKAQNQQ

SEQ ID NO: 2261 - protein, 16 aa, synthetic construct
TSYGNGSPHSKAQNQQ

SEQ ID NO: 2262 - protein, 16 aa, synthetic construct
TEKGSGSPHSKAQNQQ

SEQ ID NO: 2263 - protein, 16 aa, synthetic construct
TINGSGSPHSKSQTQQ

SEQ ID NO: 2264 - protein, 16 aa, synthetic construct
TERISGSPHSKAQNQQ

SEQ ID NO: 2265 - protein, 16 aa, synthetic construct
TERASGSPHSKAQNQQ

SEQ ID NO: 2266 - protein, 16 aa, synthetic construct
ELHGSGSPHSKAQNQQ

SEQ ID NO: 2267 - protein, 16 aa, synthetic construct
AINGSGSPHSKAQNLA

SEQ ID NO: 2268 - protein, 16 aa, synthetic construct
TVNGSGSPHSKSQNQL

SEQ ID NO: 2269 - protein, 16 aa, synthetic construct
TERNSGSPHSKAQNQQ

SEQ ID NO: 2270 - protein, 16 aa, synthetic construct
SVNGNGSPHSKAQNQQ

SEQ ID NO: 2271 - protein, 16 aa, synthetic construct
TFNGSGSPHSKAQGQQ

SEQ ID NO: 2272 - protein, 16 aa, synthetic construct
TERVSGSPHSKAQNQQ

SEQ ID NO: 2273 - protein, 16 aa, synthetic construct
TINGSGSPHSKALNRQ

SEQ ID NO: 2274 - protein, 16 aa, synthetic construct
TERLSGSPHSKAQNQQ

SEQ ID NO: 2275 - protein, 16 aa, synthetic construct
TDNGSGSPHSKAHNQQ

SEQ ID NO: 2276 - protein, 16 aa, synthetic construct
TFHGSGSPHSKTQNQQ

SEQ ID NO: 2277 - protein, 16 aa, synthetic construct
TINGGGSPHSKAQTQQ

SEQ ID NO: 2278 - protein, 16 aa, synthetic construct
TSNGSGSPHSKAQNPP

SEQ ID NO: 2279 - protein, 16 aa, synthetic construct
TINGSGSPHSKAQNLQ

SEQ ID NO: 2280 - protein, 16 aa, synthetic construct
TVHGNGSPHSKAQNQQ

SEQ ID NO: 2281 - protein, 16 aa, synthetic construct
TINGGGSPHSKAQNQQ

SEQ ID NO: 2282 - protein, 16 aa, synthetic construct
TENMSGSPHSKAQNQQ

SEQ ID NO: 2283 - protein, 16 aa, synthetic construct
TENVSGSPHSKAQNQQ

SEQ ID NO: 2284 - protein, 16 aa, synthetic construct
TSSGSGSPHSKAQYQQ

SEQ ID NO: 2285 - protein, 16 aa, synthetic construct
TIDGGGSPHSKAQNKQ

SEQ ID NO: 2286 - protein, 16 aa, synthetic construct
TEKVSGSPHSKAQNQQ

SEQ ID NO: 2287 - protein, 16 aa, synthetic construct
AINGSGSPHSKAQDQE

SEQ ID NO: 2288 - protein, 16 aa, synthetic construct
TCNKSGSPHSKAQNQQ

SEQ ID NO: 2289 - protein, 16 aa, synthetic construct
TINGGGSPHSKAQNQL

SEQ ID NO: 2290 - protein, 16 aa, synthetic construct
NINGGGSPHSKAQNQQ

SEQ ID NO: 2291 - protein, 16 aa, synthetic construct
TEHLSGSPHSKAQNQQ

SEQ ID NO: 2292 - protein, 16 aa, synthetic construct
AEMGSGSPHSKAQNQQ

SEQ ID NO: 2293 - protein, 16 aa, synthetic construct
ATNGSGSPHSKAQNHQ

SEQ ID NO: 2294 - protein, 16 aa, synthetic construct
AIKGSGSPHSKAQDQQ

SEQ ID NO: 2295 - protein, 16 aa, synthetic construct
TINGGGSPHSKSQNQL

SEQ ID NO: 2296 - protein, 16 aa, synthetic construct
TVNGNGSPHSKAQNKQ

SEQ ID NO: 2297 - protein, 16 aa, synthetic construct
TINGSGSPHSKGHWQQ

SEQ ID NO: 2298 - protein, 16 aa, synthetic construct
TDKTSGSPHSKAQNQQ

SEQ ID NO: 2299 - protein, 16 aa, synthetic construct
TFKGSGSPHSKAPNQQ

SEQ ID NO: 2300 - protein, 16 aa, synthetic construct
TVNGSGSPHSKAQNQL

SEQ ID NO: 2301 - protein, 16 aa, synthetic construct
TINGSGSPHSKRPEQQ

SEQ ID NO: 2302 - protein, 16 aa, synthetic construct
TINGSGSPHSKAQRTM

SEQ ID NO: 2303 - protein, 16 aa, synthetic construct
TEKASGSPHSKAQNQQ

SEQ ID NO: 2304 - protein, 16 aa, synthetic construct
SDQGSGSPHSKAQNQQ

SEQ ID NO: 2305 - protein, 16 aa, synthetic construct
TEITSGSPHSKAQNQQ

SEQ ID NO: 2306 - protein, 16 aa, synthetic construct
TDKSSGSPHSKAQNQQ

SEQ ID NO: 2307 - protein, 16 aa, synthetic construct
TIDGSGSPHSKAQNQQ

SEQ ID NO: 2308 - protein, 16 aa, synthetic construct
TVNGNGSPHSKAQNQH

SEQ ID NO: 2309 - protein, 16 aa, synthetic construct
NTNGSGSPHSKAQNQQ

SEQ ID NO: 2310 - protein, 16 aa, synthetic construct
TETHSGSPHSKAQNQQ

SEQ ID NO: 2311 - protein, 16 aa, synthetic construct
TINGGGSPHSKALNQQ

SEQ ID NO: 2312 - protein, 16 aa, synthetic construct
TINGSGSPHSKALHQH

SEQ ID NO: 2313 - protein, 16 aa, synthetic construct
TINGTGSPHSKAQNHQ

SEQ ID NO: 2314 - protein, 16 aa, synthetic construct
TINGSGSPHSKAQHRI

SEQ ID NO: 2315 - protein, 16 aa, synthetic construct
TINGSGSPHSKAQYIH

SEQ ID NO: 2316 - protein, 16 aa, synthetic construct
TENISGSPHSKAQNQQ

SEQ ID NO: 2317 - protein, 16 aa, synthetic construct
TIIGGGSPHSKAHNQQ

SEQ ID NO: 2318 - protein, 16 aa, synthetic construct
TINGSGSPHSKAQKFE

SEQ ID NO: 2319 - protein, 16 aa, synthetic construct
TSNESGSPHSKAQNHQ

SEQ ID NO: 2320 - protein, 16 aa, synthetic construct
TINGSGSPHSKAQFPS

SEQ ID NO: 2321 - protein, 16 aa, synthetic construct
TERPSGSPHSKAQNQQ

SEQ ID NO: 2322 - protein, 16 aa, synthetic construct
TINGNGSPHSKAQNPL

SEQ ID NO: 2323 - protein, 16 aa, synthetic construct
SIKGNGSPHSKAQNQQ

SEQ ID NO: 2324 - protein, 16 aa, synthetic construct
TERMSGSPHSKAQNQQ

SEQ ID NO: 2325 - protein, 16 aa, synthetic construct
TERSSGSPHSKAQNQQ

SEQ ID NO: 2326 - protein, 16 aa, synthetic construct
TELHSGSPHSKAQNQQ

SEQ ID NO: 2327 - protein, 16 aa, synthetic construct
TELTSGSPHSKAQNQQ

SEQ ID NO: 2328 - protein, 16 aa, synthetic construct
TINGSGSPHSKAHNQQ

SEQ ID NO: 2329 - protein, 16 aa, synthetic construct
TINGGGSPHSKAQSQQ

SEQ ID NO: 2330 - protein, 16 aa, synthetic construct
TINGSGSPHSKAQAIK

SEQ ID NO: 2331 - protein, 16 aa, synthetic construct
TENTSGSPHSKAQNQQ

SEQ ID NO: 2332 - protein, 16 aa, synthetic construct
TIDGSGSPHSKGQNRQ

SEQ ID NO: 2333 - protein, 16 aa, synthetic construct
NINGSGSPHSKAQSQQ

SEQ ID NO: 2334 - protein, 16 aa, synthetic construct
TINGSVSPHGKAQNQL

SEQ ID NO: 2335 - protein, 16 aa, synthetic construct
TSNASGSPHSKAQNQL

SEQ ID NO: 2336 - protein, 16 aa, synthetic construct
TEARSGSPHSKAQNQQ

SEQ ID NO: 2337 - protein, 16 aa, synthetic construct
TEKNSGSPHSKAQNQQ

SEQ ID NO: 2338 - protein, 16 aa, synthetic construct
TANGSGSPHSKAQYQQ

SEQ ID NO: 2339 - protein, 16 aa, synthetic construct
TVNGSGSPHSKAQYQH

SEQ ID NO: 2340 - protein, 16 aa, synthetic construct
TINGSGSPHTKAQNPQ

SEQ ID NO: 2341 - protein, 16 aa, synthetic construct
TINGSGSPHSKGQNPP

SEQ ID NO: 2342 - protein, 16 aa, synthetic construct
TIIGSGSPHSKAQHQL

SEQ ID NO: 2343 - protein, 16 aa, synthetic construct
TINGSGSPHSKAQSPP

SEQ ID NO: 2344 - protein, 16 aa, synthetic construct
TIYGSGSPHSKAQNQQ

SEQ ID NO: 2345 - protein, 16 aa, synthetic construct
TINGSGSPHSKAQAKL

SEQ ID NO: 2346 - protein, 16 aa, synthetic construct
TDKNSGSPHSKAQNQQ

SEQ ID NO: 2347 - protein, 16 aa, synthetic construct
TINGSGSPHSKTKSQQ

SEQ ID NO: 2348 - protein, 16 aa, synthetic construct
TINGSGSPHSKAQDRP

SEQ ID NO: 2349 - protein, 16 aa, synthetic construct
TINGIGSPHSKAQNLG

SEQ ID NO: 2350 - protein, 16 aa, synthetic construct
TINGSGSPHSKAQSQQ

SEQ ID NO: 2351 - protein, 16 aa, synthetic construct
TENLSGSPHSKAQNQQ

SEQ ID NO: 2352 - protein, 16 aa, synthetic construct
TINGSGSPHSKAQAFH

SEQ ID NO: 2353 - protein, 16 aa, synthetic construct
TINGSGSPHSKAQKQQ

SEQ ID NO: 2354 - protein, 16 aa, synthetic construct
TFSGSGSPHSKAQNLQ

SEQ ID NO: 2355 - protein, 16 aa, synthetic construct
AINGSGSPHSKAQNAQ

SEQ ID NO: 2356 - protein, 16 aa, synthetic construct
TESWSGSPHSKAQNQQ

SEQ ID NO: 2357 - protein, 16 aa, synthetic construct
TTNGSGSPHSKAHNQL

SEQ ID NO: 2358 - protein, 16 aa, synthetic construct
TVNGNGSPHSKAQNHQ

SEQ ID NO: 2359 - protein, 16 aa, synthetic construct
TEDKSGSPHSKAQNQQ

SEQ ID NO: 2360 - protein, 16 aa, synthetic construct
TESASGSPHSKAQNQQ

SEQ ID NO: 2361 - protein, 16 aa, synthetic construct
TNNGSGSPHSKAQNQQ

SEQ ID NO: 2362 - protein, 16 aa, synthetic construct
TSNGGGSPHSKAQNLQ

SEQ ID NO: 2363 - protein, 16 aa, synthetic construct
TDKMSGSPHSKAQNQQ

SEQ ID NO: 2364 - protein, 16 aa, synthetic construct
EVHGSGSPHSKAQNQQ

SEQ ID NO: 2365 - protein, 16 aa, synthetic construct
TINGSGSPHSKAQKLN

SEQ ID NO: 2366 - protein, 16 aa, synthetic construct
TINGGGSPHSKSQNQH

SEQ ID NO: 2367 - protein, 16 aa, synthetic construct
TVNGGGSPHSKAQSQQ

SEQ ID NO: 2368 - protein, 16 aa, synthetic construct
TTNGSGSPHSKAQYQH

SEQ ID NO: 2369 - protein, 16 aa, synthetic construct
TISGSGSPHSKAQYQH

SEQ ID NO: 2370 - protein, 16 aa, synthetic construct
TESTSGSPHSKAQNQQ

SEQ ID NO: 2371 - protein, 16 aa, synthetic construct
TINGSGSPHSKSQNVQ

SEQ ID NO: 2372 - protein, 16 aa, synthetic construct
SINGSGSPHSKAQAQQ

SEQ ID NO: 2373 - protein, 16 aa, synthetic construct
TVNGSGSPHSKAQNLQ

SEQ ID NO: 2374 - protein, 16 aa, synthetic construct
TVRDSGSPHSKAQNQQ

SEQ ID NO: 2375 - protein, 16 aa, synthetic construct
TFNASGSPHSKAPNQQ

SEQ ID NO: 2376 - protein, 16 aa, synthetic construct
TDRMSGSPHSKAQNQQ

SEQ ID NO: 2377 - protein, 16 aa, synthetic construct
TINGSGSPHSKAQTPP

SEQ ID NO: 2378 - protein, 16 aa, synthetic construct
TIKGSGSPHSKAQNQQ

SEQ ID NO: 2379 - protein, 16 aa, synthetic construct
NHIGSGSPHSKAQNQQ

SEQ ID NO: 2380 - protein, 16 aa, synthetic construct
TINGSGSPHSKAQYQH

SEQ ID NO: 2381 - protein, 16 aa, synthetic construct
TIPIDGSPHSKAQNQQ

SEQ ID NO: 2382 - protein, 16 aa, synthetic construct
TINGSGSPHSKAQGQQ

SEQ ID NO: 2383 - protein, 16 aa, synthetic construct
TFNGSGSPHNKAQNHQ

SEQ ID NO: 2384 - protein, 16 aa, synthetic construct
ESDGSGSPHSKAQNQQ

SEQ ID NO: 2385 - protein, 16 aa, synthetic construct
TINGSGSPHSKAQPPA

SEQ ID NO: 2386 - protein, 16 aa, synthetic construct
TINGSGSPHSKAQERP

SEQ ID NO: 2387 - protein, 16 aa, synthetic construct
TIKGSGSPHSKAQDLQ

SEQ ID NO: 2388 - protein, 16 aa, synthetic construct
TDLKSGSPHSKAQNQQ

SEQ ID NO: 2389 - protein, 16 aa, synthetic construct
TINGGGSPHSKAQNPP

SEQ ID NO: 2390 - protein, 16 aa, synthetic construct
TINGSGSPHSKAQAMH

SEQ ID NO: 2391 - protein, 16 aa, synthetic construct
TVPNSGSPHSKAQNQQ

SEQ ID NO: 2392 - protein, 16 aa, synthetic construct
TVIGSGSPHSKALNQQ

SEQ ID NO: 2393 - protein, 16 aa, synthetic construct
TINGSGSPHSKAQHPS

SEQ ID NO: 2394 - protein, 16 aa, synthetic construct
TINGLGSPHSKSQNQQ

SEQ ID NO: 2395 - protein, 16 aa, synthetic construct
TINGTGSPHSKAQNQQ

SEQ ID NO: 2396 - protein, 16 aa, synthetic construct
TINGSGSPHSKAPGLQ

SEQ ID NO: 2397 - protein, 16 aa, synthetic construct
TINGSGSPHSKAQGIR

SEQ ID NO: 2398 - protein, 16 aa, synthetic construct
TESHSGSPHSKAQNQQ

SEQ ID NO: 2399 - protein, 16 aa, synthetic construct
TINGSGSPHSKAQAPA

SEQ ID NO: 2400 - protein, 16 aa, synthetic construct
TINGSGSPHSKSQSQQ

SEQ ID NO: 2401 - protein, 16 aa, synthetic construct
AEHGSGSPHSKAQNQQ

SEQ ID NO: 2402 - protein, 16 aa, synthetic construct
TEDRSGSPHSKAQNQQ

SEQ ID NO: 2403 - protein, 16 aa, synthetic construct
NCLGSGSPHSKAQNQQ

SEQ ID NO: 2404 - protein, 16 aa, synthetic construct
TDRGSGSPHSKAQNQQ

SEQ ID NO: 2405 - protein, 16 aa, synthetic construct
TINGSGSPHSKAQIPP

SEQ ID NO: 2406 - protein, 16 aa, synthetic construct
TVKGSGSPHSKAQDQQ

SEQ ID NO: 2407 - protein, 16 aa, synthetic construct
NADGSGSPHSKAQNQQ

SEQ ID NO: 2408 - protein, 16 aa, synthetic construct
TDKVSGSPHSKAQNQQ

SEQ ID NO: 2409 - protein, 16 aa, synthetic construct
TITGSGSPHSKAQTQL

SEQ ID NO: 2410 - protein, 16 aa, synthetic construct
TINGSGSPHSKAQAPS

SEQ ID NO: 2411 - protein, 16 aa, synthetic construct
NCVGSGSPHSKAQNQQ

SEQ ID NO: 2412 - protein, 16 aa, synthetic construct
TIRDAGSPHSKAQNQQ

SEQ ID NO: 2413 - protein, 16 aa, synthetic construct
TVKDSGSPHSKAQNQQ

SEQ ID NO: 2414 - protein, 16 aa, synthetic construct
NALGSGSPHSKAQNQQ

SEQ ID NO: 2415 - protein, 16 aa, synthetic construct
VINGSGSPHSKGQNQQ

SEQ ID NO: 2416 - protein, 16 aa, synthetic construct
TVNGGGSPHSKAQNQQ

SEQ ID NO: 2417 - protein, 16 aa, synthetic construct
TIQDGGSPHSKAQNQQ

SEQ ID NO: 2418 - protein, 16 aa, synthetic construct
TISGGGSPHSKAQNQQ

SEQ ID NO: 2419 - protein, 16 aa, synthetic construct
TSNASGSPHSKAHNQQ

SEQ ID NO: 2420 - protein, 16 aa, synthetic construct
TINGSGSPHSKAQNTY

SEQ ID NO: 2421 - protein, 16 aa, synthetic construct
TINGSGSPHSKSQNQH

SEQ ID NO: 2422 - protein, 16 aa, synthetic construct
TINGGGSPHSKAQDKQ

SEQ ID NO: 2423 - protein, 16 aa, synthetic construct
TEFVSGSPHSKAQNQQ

SEQ ID NO: 2424 - protein, 16 aa, synthetic construct
TVNGSGSPHSKAQNHL

SEQ ID NO: 2425 - protein, 16 aa, synthetic construct
TREISGSPHSKAQNQQ

SEQ ID NO: 2426 - protein, 16 aa, synthetic construct
TINGSGSPHSKAQIGM

SEQ ID NO: 2427 - protein, 16 aa, synthetic construct
TIDGSGSPHSKALNKQ

SEQ ID NO: 2428 - protein, 16 aa, synthetic construct
TIIGGGSPHSKAQNPQ

SEQ ID NO: 2429 - protein, 16 aa, synthetic construct
QGEGSGSPHSKAQNQQ

SEQ ID NO: 2430 - protein, 16 aa, synthetic construct
TINGTGSPHSKAPNQL

SEQ ID NO: 2431 - protein, 16 aa, synthetic construct
TVNGSGSPHSKAQLQQ

SEQ ID NO: 2432 - protein, 16 aa, synthetic construct
TFNGGGSPHSKAQYQQ

SEQ ID NO: 2433 - protein, 16 aa, synthetic construct
SINGSGSPHSKTQSQQ

SEQ ID NO: 2434 - protein, 16 aa, synthetic construct
TVNGGGSPHSKAQHQQ

SEQ ID NO: 2435 - protein, 16 aa, synthetic construct
SEKGSGSPHSKAQNQQ

SEQ ID NO: 2436 - protein, 16 aa, synthetic construct
NVNGSGSPHSKAQNQQ

SEQ ID NO: 2437 - protein, 16 aa, synthetic construct
GGEGSGSPHSKAQNQQ

SEQ ID NO: 2438 - protein, 16 aa, synthetic construct
TINGSGSPHSKAQRMS

SEQ ID NO: 2439 - protein, 16 aa, synthetic construct
TINGSGSPHSKAQGIL

SEQ ID NO: 2440 - protein, 16 aa, synthetic construct
EFVGSGSPHSKAQNQQ

SEQ ID NO: 2441 - protein, 16 aa, synthetic construct
TIIGSGSPHSKAQDRQ

SEQ ID NO: 2442 - protein, 16 aa, synthetic construct
SDKGSGSPHSKAQNQQ

SEQ ID NO: 2443 - protein, 16 aa, synthetic construct
TEQVSGSPHSKAQNQQ

SEQ ID NO: 2444 - protein, 16 aa, synthetic construct
TEHVSGSPHSKAQNQQ

SEQ ID NO: 2445 - protein, 16 aa, synthetic construct
TINGSGSPHSKARDWQ

SEQ ID NO: 2446 - protein, 16 aa, synthetic construct
TENASGSPHSKAQNQQ

SEQ ID NO: 2447 - protein, 16 aa, synthetic construct
EVQGSGSPHSKAQNQQ

SEQ ID NO: 2448 - protein, 16 aa, synthetic construct
TINGSGSPHSKAQNTH

SEQ ID NO: 2449 - protein, 16 aa, synthetic construct
TINGSGSPHSKAPNLQ

SEQ ID NO: 2450 - protein, 16 aa, synthetic construct
TINGSGSPHSKAQERS

SEQ ID NO: 2451 - protein, 16 aa, synthetic construct
TSNGSGSPHSKAQNYQ

SEQ ID NO: 2452 - protein, 16 aa, synthetic construct
TEYISGSPHSKAQNQQ

SEQ ID NO: 2453 - protein, 16 aa, synthetic construct
TINGSGSPHSKAQRTC

SEQ ID NO: 2454 - protein, 16 aa, synthetic construct
TINGSGSPHSKAQIGH

SEQ ID NO: 2455 - protein, 16 aa, synthetic construct
NCWGSGSPHSKAQNQQ

SEQ ID NO: 2456 - protein, 16 aa, synthetic construct
TINGSGSPHSKAQGAI

SEQ ID NO: 2457 - protein, 16 aa, synthetic construct
TDVNSGSPHSKAQNQQ

SEQ ID NO: 2458 - protein, 16 aa, synthetic construct
SDIGSGSPHSKAQNQQ

SEQ ID NO: 2459 - protein, 16 aa, synthetic construct
TINGSGSPHSKAQVPP

SEQ ID NO: 2460 - protein, 16 aa, synthetic construct
TINGSGSPHSKAQVQQ

SEQ ID NO: 2461 - protein, 16 aa, synthetic construct
TINGSGSPHSKALMRQ

SEQ ID NO: 2462 - protein, 16 aa, synthetic construct
TINGSGSPHSKAQYSV

SEQ ID NO: 2463 - protein, 16 aa, synthetic construct
NSIGSGSPHSKAQNQQ

SEQ ID NO: 2464 - protein, 16 aa, synthetic construct
TINGSGSPHSKVPNLQ

SEQ ID NO: 2465 - protein, 16 aa, synthetic construct
AINGSGSPHSKAQSQQ

SEQ ID NO: 2466 - protein, 16 aa, synthetic construct
TINGSGSPHSKAQAIT

SEQ ID NO: 2467 - protein, 16 aa, synthetic construct
TINGSGSPHSKAQKTL

SEQ ID NO: 2468 - protein, 16 aa, synthetic construct
TVNGSGSPHSKAQNQW

SEQ ID NO: 2469 - protein, 16 aa, synthetic construct
TINGSGSPHSKAQLHH

SEQ ID NO: 2470 - protein, 16 aa, synthetic construct
TEQTSGSPHSKAQNQQ

SEQ ID NO: 2471 - protein, 16 aa, synthetic construct
TINGSGSPHSKAQNII

SEQ ID NO: 2472 - protein, 16 aa, synthetic construct
NSLGSGSPHSKAQNQQ

SEQ ID NO: 2473 - protein, 16 aa, synthetic construct
TIPMEGSPHSKAQNQQ

SEQ ID NO: 2474 - protein, 16 aa, synthetic construct
TINGSGSPHSKAQGHH

SEQ ID NO: 2475 - protein, 16 aa, synthetic construct
TDRTSGSPHSKAQNQQ

SEQ ID NO: 2476 - protein, 16 aa, synthetic construct
TINGSGSPHSKAQSKV

SEQ ID NO: 2477 - protein, 16 aa, synthetic construct
EVVGSGSPHSKAQNQQ

SEQ ID NO: 2478 - protein, 16 aa, synthetic construct
TINGSGSPHSKAQLPS

SEQ ID NO: 2479 - protein, 16 aa, synthetic construct
TINGSGSPHSKAIGKQ

SEQ ID NO: 2480 - protein, 16 aa, synthetic construct
TEPTSGSPHSKAQNQQ

SEQ ID NO: 2481 - protein, 16 aa, synthetic construct
TVNGGGSPHSKSQNQQ

SEQ ID NO: 2482 - protein, 16 aa, synthetic construct
TINGSGSPHSKAQAIH

SEQ ID NO: 2483 - protein, 16 aa, synthetic construct
TINGSGSPHSKAQHGL

SEQ ID NO: 2484 - protein, 16 aa, synthetic construct
SELGSGSPHSKAQNQQ

SEQ ID NO: 2485 - protein, 16 aa, synthetic construct
TINGSGSPHSKAQFMC

SEQ ID NO: 2486 - protein, 16 aa, synthetic construct
TINVSGSPHSKAQGQQ

SEQ ID NO: 2487 - protein, 16 aa, synthetic construct
TINGGGSPHSKAQNQM

SEQ ID NO: 2488 - protein, 16 aa, synthetic construct
TVNGSGSPHSKAQHLQ

SEQ ID NO: 2489 - protein, 16 aa, synthetic construct
TIRENGSPHSKAQNQQ

SEQ ID NO: 2490 - protein, 16 aa, synthetic construct
TINGSGSPHSKTQNHQ

SEQ ID NO: 2491 - protein, 16 aa, synthetic construct
TINGSGSPHSKAQPAR

SEQ ID NO: 2492 - protein, 16 aa, synthetic construct
TVNGSGSPHSKAQSLQ

SEQ ID NO: 2493 - protein, 16 aa, synthetic construct
TINGSGSPHSKSQSQL

SEQ ID NO: 2494 - protein, 16 aa, synthetic construct
TINGSASPHSKAHSQQ

SEQ ID NO: 2495 - protein, 16 aa, synthetic construct
TWQNSGSPHSKAQNQQ

SEQ ID NO: 2496 - protein, 16 aa, synthetic construct
TINGSGSPHSKAQDRQ

SEQ ID NO: 2497 - protein, 16 aa, synthetic construct
TINGSGSPHSKAQMPS

SEQ ID NO: 2498 - protein, 16 aa, synthetic construct
TNNGGGSPHSKAQNLQ

SEQ ID NO: 2499 - protein, 16 aa, synthetic construct
TINGSGSPHSKAQGSL

SEQ ID NO: 2500 - protein, 16 aa, synthetic construct
TEVTSGSPHSKAQNQQ

SEQ ID NO: 2501 - protein, 16 aa, synthetic construct
SINGGGSPHSKAQYQQ

SEQ ID NO: 2502 - protein, 16 aa, synthetic construct
TVIGSGSPHSKSQNQQ

SEQ ID NO: 2503 - protein, 16 aa, synthetic construct
AVNVSGSPHSKAQNQQ

SEQ ID NO: 2504 - protein, 16 aa, synthetic construct
TVNGNGSPHSKSQNQQ

SEQ ID NO: 2505 - protein, 16 aa, synthetic construct
TDRNSGSPHSKAQNQQ

SEQ ID NO: 2506 - protein, 16 aa, synthetic construct
TINGSGSPHSKAQVPA

SEQ ID NO: 2507 - protein, 16 aa, synthetic construct
GVLGSGSPHSKAQNQQ

SEQ ID NO: 2508 - protein, 16 aa, synthetic construct
TLNGNGSPHSKAQNLQ

SEQ ID NO: 2509 - protein, 16 aa, synthetic construct
AINGSGSPHSKAQDKQ

SEQ ID NO: 2510 - protein, 16 aa, synthetic construct
TSNGSGSPHSKAHYQQ

SEQ ID NO: 2511 - protein, 16 aa, synthetic construct
TINGSGSPHSKAQVPS

SEQ ID NO: 2512 - protein, 16 aa, synthetic construct
TELRSGSPHSKAQNQQ

SEQ ID NO: 2513 - protein, 16 aa, synthetic construct
NINGSGSPHSKAQNHQ

SEQ ID NO: 2514 - protein, 16 aa, synthetic construct
TVNGGGSPHSKAQNHQ

SEQ ID NO: 2515 - protein, 16 aa, synthetic construct
TINGSGSPHSKARGEQ

SEQ ID NO: 2516 - protein, 16 aa, synthetic construct
TINGGGSPHSKAQYQH

SEQ ID NO: 2517 - protein, 16 aa, synthetic construct
TEDLSGSPHSKAQNQQ

SEQ ID NO: 2518 - protein, 16 aa, synthetic construct
TINGSGSPHSKAPGQQ

SEQ ID NO: 2519 - protein, 16 aa, synthetic construct
TIPKNGSPHSKAQNQQ

SEQ ID NO: 2520 - protein, 16 aa, synthetic construct
TINGSGSPHSKAQSLQ

SEQ ID NO: 2521 - protein, 16 aa, synthetic construct
TINGSGSPHSKRLEQQ

SEQ ID NO: 2522 - protein, 16 aa, synthetic construct
TERGSGSPHSKAQNQQ

SEQ ID NO: 2523 - protein, 16 aa, synthetic construct
TVNGSGSPHSKAPNQQ

SEQ ID NO: 2524 - protein, 16 aa, synthetic construct
TSNGSGSPHSKAQNQS

SEQ ID NO: 2525 - protein, 16 aa, synthetic construct
TINGSGSPHSKAQKVI

SEQ ID NO: 2526 - protein, 16 aa, synthetic construct
TEGISGSPHSKAQNQQ

SEQ ID NO: 2527 - protein, 16 aa, synthetic construct
TINGSGSPHSKAQNND

SEQ ID NO: 2528 - protein, 16 aa, synthetic construct
TINGSGSPHSKAQSVH

SEQ ID NO: 2529 - protein, 16 aa, synthetic construct
TINGSGSPHSKAQPLG

SEQ ID NO: 2530 - protein, 16 aa, synthetic construct
TINKEGSPHSKAQNQQ

SEQ ID NO: 2531 - protein, 16 aa, synthetic construct
TCNASGSPHSKAQNQQ

SEQ ID NO: 2532 - protein, 16 aa, synthetic construct
AINGSGSPHSKAHNQE

SEQ ID NO: 2533 - protein, 16 aa, synthetic construct
TEGLSGSPHSKAQNQQ

SEQ ID NO: 2534 - protein, 16 aa, synthetic construct
TRDASGSPHSKAQNQQ

SEQ ID NO: 2535 - protein, 16 aa, synthetic construct
TSNGSGSPHSKAQNLQ

SEQ ID NO: 2536 - protein, 16 aa, synthetic construct
TGNGSGSPHSKAQIQQ

SEQ ID NO: 2537 - protein, 16 aa, synthetic construct
TVNGGGSPHSKAQNLQ

SEQ ID NO: 2538 - protein, 16 aa, synthetic construct
TDRSSGSPHSKAQNQQ

SEQ ID NO: 2539 - protein, 16 aa, synthetic construct
TINGSGSPHSKAQVRN

SEQ ID NO: 2540 - protein, 16 aa, synthetic construct
TINGSGSPHSKAPSNQ

SEQ ID NO: 2541 - protein, 16 aa, synthetic construct
TINGSGSPHSKAQVGH

SEQ ID NO: 2542 - protein, 16 aa, synthetic construct
NAIGSGSPHSKAQNQQ

SEQ ID NO: 2543 - protein, 16 aa, synthetic construct
AENGSGSPHSKAQNQQ

SEQ ID NO: 2544 - protein, 16 aa, synthetic construct
TINGSGSPHSKAQRDI

SEQ ID NO: 2545 - protein, 16 aa, synthetic construct
TINGSGSPHSKAQMPN

SEQ ID NO: 2546 - protein, 16 aa, synthetic construct
TVNGSGSPHSKSQNQQ

SEQ ID NO: 2547 - protein, 16 aa, synthetic construct
TIPAIGSPHSKAQNQQ

SEQ ID NO: 2548 - protein, 16 aa, synthetic construct
TINGSGSPHSKARGLQ

SEQ ID NO: 2549 - protein, 16 aa, synthetic construct
TELGSGSPHSKAQNQQ

SEQ ID NO: 2550 - protein, 16 aa, synthetic construct
AETGSGSPHSKAQNQQ

SEQ ID NO: 2551 - protein, 16 aa, synthetic construct
TINGSGSPHSKLQKQQ

SEQ ID NO: 2552 - protein, 16 aa, synthetic construct
TINGSGSPHSKAPSLQ

SEQ ID NO: 2553 - protein, 16 aa, synthetic construct
TINGSGSPHSKAQRDQ

SEQ ID NO: 2554 - protein, 16 aa, synthetic construct
TDVGSGSPHSKAQNQQ

SEQ ID NO: 2555 - protein, 16 aa, synthetic construct
TINGSGSPHSKNRDQQ

SEQ ID NO: 2556 - protein, 16 aa, synthetic construct
SINGSGSPHSKAPNLQ

SEQ ID NO: 2557 - protein, 16 aa, synthetic construct
TINGSGSPHSKAQAKG

SEQ ID NO: 2558 - protein, 16 aa, synthetic construct
TVNGSGSPHSKAQDKQ

SEQ ID NO: 2559 - protein, 16 aa, synthetic construct
TINGGGSPHSKAQNPQ

SEQ ID NO: 2560 - protein, 16 aa, synthetic construct
TINGSGSPHSKAQSAH

SEQ ID NO: 2561 - protein, 16 aa, synthetic construct
TINGNGSPHSKSQNQH

SEQ ID NO: 2562 - protein, 16 aa, synthetic construct
TVPTSGSPHSKAQNQQ

SEQ ID NO: 2563 - protein, 16 aa, synthetic construct
TIDGSGSPHSKSQNHQ

SEQ ID NO: 2564 - protein, 16 aa, synthetic construct
TDVKSGSPHSKAQNQQ

SEQ ID NO: 2565 - protein, 16 aa, synthetic construct
AINRSGSPHSKAQDQQ

SEQ ID NO: 2566 - protein, 16 aa, synthetic construct
TINGSGSPHSKAQSTM

SEQ ID NO: 2567 - protein, 16 aa, synthetic construct
TVNASGSPHSKAQNQL

SEQ ID NO: 2568 - protein, 16 aa, synthetic construct
TINGSGSPHSKAQREM

SEQ ID NO: 2569 - protein, 16 aa, synthetic construct
TVHGSGSPHSKAQSQQ

SEQ ID NO: 2570 - protein, 16 aa, synthetic construct
TINGGGSPHSKSQNRQ

SEQ ID NO: 2571 - protein, 16 aa, synthetic construct
TINGSGSPHSKAQYRA

SEQ ID NO: 2572 - protein, 16 aa, synthetic construct
TINGGGSPHSKAQRQQ

SEQ ID NO: 2573 - protein, 16 aa, synthetic construct
TEPMSGSPHSKAQNQQ

SEQ ID NO: 2574 - protein, 16 aa, synthetic construct
TINGSGSPHSKNQWQQ

SEQ ID NO: 2575 - protein, 16 aa, synthetic construct
ETAGSGSPHSKAQNQQ

SEQ ID NO: 2576 - protein, 16 aa, synthetic construct
TINGSGSPHSKAQRMN

SEQ ID NO: 2577 - protein, 16 aa, synthetic construct
NNLGSGSPHSKAQNQQ

SEQ ID NO: 2578 - protein, 16 aa, synthetic construct
TINGSGSPHAKAQNHQ

SEQ ID NO: 2579 - protein, 16 aa, synthetic construct
TIIKNGSPHSKAQNQQ

SEQ ID NO: 2580 - protein, 16 aa, synthetic construct
TINGSGSPHSKAGDSQ

SEQ ID NO: 2581 - protein, 16 aa, synthetic construct
TINGSGSPHSKLKSQQ

SEQ ID NO: 2582 - protein, 16 aa, synthetic construct
TINGSGSPHSKAQKIS

SEQ ID NO: 2583 - protein, 16 aa, synthetic construct
TEYNSGSPHSKAQNQQ

SEQ ID NO: 2584 - protein, 16 aa, synthetic construct
TINGSGSPHSKAPSMQ

SEQ ID NO: 2585 - protein, 16 aa, synthetic construct
AINGSGSPHSKAQNQQ

SEQ ID NO: 2586 - protein, 16 aa, synthetic construct
TINGSGSPHSKASPRQ

SEQ ID NO: 2587 - protein, 16 aa, synthetic construct
TINGSGSPHSKRMEQQ

SEQ ID NO: 2588 - protein, 16 aa, synthetic construct
TINGSGSPHSKAQYQN

SEQ ID NO: 2589 - protein, 16 aa, synthetic construct
TINGSGSPHSKAQYYV

SEQ ID NO: 2590 - protein, 16 aa, synthetic construct
TINGSGSPHSKLRRQQ

SEQ ID NO: 2591 - protein, 16 aa, synthetic construct
TINGSGSPHSKAGCGQ

SEQ ID NO: 2592 - protein, 16 aa, synthetic construct
SMNGSGSPHSRAQNQQ

SEQ ID NO: 2593 - protein, 16 aa, synthetic construct
TINGSGSPHSKRLRQQ

SEQ ID NO: 2594 - protein, 16 aa, synthetic construct
TINGSGSPHSLRRNQQ

SEQ ID NO: 2595 - protein, 16 aa, synthetic construct
TINGSGSPHSRGRNQQ

SEQ ID NO: 2596 - protein, 16 aa, synthetic construct
TINGSGSPHSSRRNQQ

SEQ ID NO: 2597 - protein, 16 aa, synthetic construct
TINGSGSPHSKAFRLQ

SEQ ID NO: 2598 - protein, 16 aa, synthetic construct
TINGSCSPHRKAQNQQ

SEQ ID NO: 2599 - protein, 16 aa, synthetic construct
TINGSGSPHFLRQNQQ

SEQ ID NO: 2600 - protein, 16 aa, synthetic construct
TINGSGSPHSLRFNQQ

SEQ ID NO: 2601 - protein, 16 aa, synthetic construct
TINGSGSPHSKWLLQQ

SEQ ID NO: 2602 - protein, 16 aa, synthetic construct
TINGSGSPHSKRRLQQ

SEQ ID NO: 2603 - protein, 16 aa, synthetic construct
TINGSGSPHSKAQRKL

SEQ ID NO: 2604 - protein, 16 aa, synthetic construct
TINGSGSPHSKALRRQ

SEQ ID NO: 2605 - protein, 16 aa, synthetic construct
TINGSGSPHSKAQRLR

SEQ ID NO: 2606 - protein, 16 aa, synthetic construct
YLSGSGSPHSKAQNQQ

SEQ ID NO: 2607 - protein, 16 aa, synthetic construct
TINGSGSPHSKAQRRL

SEQ ID NO: 2608 - protein, 16 aa, synthetic construct
TINGSGSPHSKARRQQ

SEQ ID NO: 2609 - protein, 16 aa, synthetic construct
TINGSGSPHSKARRLQ

SEQ ID NO: 2610 - protein, 16 aa, synthetic construct
TINGSGSPHSKSRRQQ

SEQ ID NO: 2611 - protein, 16 aa, synthetic construct
TINGLLSPHWKAQNQQ

SEQ ID NO: 2612 - protein, 16 aa, synthetic construct
TINGSGSPHSKARLRQ

SEQ ID NO: 2613 - protein, 16 aa, synthetic construct
TINGSGSPHSKASKRQ

SEQ ID NO: 2614 - protein, 16 aa, synthetic construct
TINGSGSPHVRRQNQQ

SEQ ID NO: 2615 - protein, 16 aa, synthetic construct
TINGSGSPHSKAQLYR

SEQ ID NO: 2616 - protein, 16 aa, synthetic construct
GLSGSGSPHSKAQNQQ

SEQ ID NO: 2617 - protein, 16 aa, synthetic construct
TINGSGSPHSKAQLTV

SEQ ID NO: 2618 - protein, 16 aa, synthetic construct
TINGHDSPHKRGQHRQ

SEQ ID NO: 2619 - protein, 16 aa, synthetic construct
MPEGHDSPHKSGQNQQ

SEQ ID NO: 2620 - protein, 16 aa, synthetic construct
MEGGHDSPHKSGQNQQ

SEQ ID NO: 2621 - protein, 16 aa, synthetic construct
MEYGHDSPHKSGQNQQ

SEQ ID NO: 2622 - protein, 16 aa, synthetic construct
AEWGHDSPHKSGQNQQ

SEQ ID NO: 2623 - protein, 16 aa, synthetic construct
CEWGHDSPHKSGQNQQ

SEQ ID NO: 2624 - protein, 16 aa, synthetic construct
ANNGQDSPHKSGQNQQ

SEQ ID NO: 2625 - protein, 16 aa, synthetic construct
IPEGHDSPHKSGQNQQ

SEQ ID NO: 2626 - protein, 16 aa, synthetic construct
ADMGHDSPHKSGQNQQ

SEQ ID NO: 2627 - protein, 16 aa, synthetic construct
IEYGHDSPHKSGQNQQ

SEQ ID NO: 2628 - protein, 16 aa, synthetic construct
ADYGHDSPHKSGQNQQ

SEQ ID NO: 2629 - protein, 16 aa, synthetic construct
IETGHDSPHKSGQNQQ

SEQ ID NO: 2630 - protein, 16 aa, synthetic construct
MEWGHDSPHKSGQNQQ

SEQ ID NO: 2631 - protein, 16 aa, synthetic construct
CEYGHDSPHKSGQNQQ

SEQ ID NO: 2632 - protein, 16 aa, synthetic construct
RINGHDSPHKSGQKQQ

SEQ ID NO: 2633 - protein, 16 aa, synthetic construct
MEIGHDSPHKSGQNQQ

SEQ ID NO: 2634 - protein, 16 aa, synthetic construct
LEYGHDSPHKSGQNQQ

SEQ ID NO: 2635 - protein, 16 aa, synthetic construct
ADWGHDSPHKSGQNQQ

SEQ ID NO: 2636 - protein, 16 aa, synthetic construct
IEIGHDSPHKSGQNQQ

SEQ ID NO: 2637 - protein, 16 aa, synthetic construct
DIMGHDSPHKSGQNQQ

SEQ ID NO: 2638 - protein, 16 aa, synthetic construct
FEQGHDSPHKSGQNQQ

SEQ ID NO: 2639 - protein, 16 aa, synthetic construct
MEFGHDSPHKSGQNQQ

SEQ ID NO: 2640 - protein, 16 aa, synthetic construct
CDQGHDSPHKSGQNQQ

SEQ ID NO: 2641 - protein, 16 aa, synthetic construct
LPEGHDSPHKSGQNQQ

SEQ ID NO: 2642 - protein, 16 aa, synthetic construct
IENGHDSPHKSGQNQQ

SEQ ID NO: 2643 - protein, 16 aa, synthetic construct
MESGHDSPHKSGQNQQ

SEQ ID NO: 2644 - protein, 16 aa, synthetic construct
AEIGHDSPHKSGQNQQ

SEQ ID NO: 2645 - protein, 16 aa, synthetic construct
VEYGHDSPHKSGQNQQ

SEQ ID NO: 2646 - protein, 16 aa, synthetic construct
IINGHDSPHKSGLTQQ

SEQ ID NO: 2647 - protein, 16 aa, synthetic construct
TSNGDDSPHKSGRNQQ

SEQ ID NO: 2648 - protein, 16 aa, synthetic construct
IEVGHDSPHKSGQNQQ

SEQ ID NO: 2649 - protein, 16 aa, synthetic construct
MEMGHDSPHKSGQNQQ

SEQ ID NO: 2650 - protein, 16 aa, synthetic construct
AEVGHDSPHKSGQNQQ

SEQ ID NO: 2651 - protein, 16 aa, synthetic construct
MDAGHDSPHKSGQNQQ

SEQ ID NO: 2652 - protein, 16 aa, synthetic construct
VEWGHDSPHKSGQNQQ

SEQ ID NO: 2653 - protein, 16 aa, synthetic construct
AEQGHDSPHKSGQNQQ

SEQ ID NO: 2654 - protein, 16 aa, synthetic construct
LEWGHDSPHKSGQNQQ

SEQ ID NO: 2655 - protein, 16 aa, synthetic construct
MELGHDSPHKSGQNQQ

SEQ ID NO: 2656 - protein, 16 aa, synthetic construct
METGHDSPHKSGQNQQ

SEQ ID NO: 2657 - protein, 16 aa, synthetic construct
MEAGHDSPHKSGQNQQ

SEQ ID NO: 2658 - protein, 16 aa, synthetic construct
IESGHDSPHKSGQNQQ

SEQ ID NO: 2659 - protein, 16 aa, synthetic construct
MEVGHDSPHKSGQNQQ

SEQ ID NO: 2660 - protein, 16 aa, synthetic construct
CEIGHDSPHKSGQNQQ

SEQ ID NO: 2661 - protein, 16 aa, synthetic construct
ATNGHDSPHKSGLNQQ

SEQ ID NO: 2662 - protein, 16 aa, synthetic construct
MDGGHDSPHKSGQNQQ

SEQ ID NO: 2663 - protein, 16 aa, synthetic construct
QEVGHDSPHKSGQNQQ

SEQ ID NO: 2664 - protein, 16 aa, synthetic construct
ADQGHDSPHKSGQNQQ

SEQ ID NO: 2665 - protein, 16 aa, synthetic construct
TINGHESPHKSAQNHQ

SEQ ID NO: 2666 - protein, 16 aa, synthetic construct
TINGHDSPHKSAQNQW

SEQ ID NO: 2667 - protein, 16 aa, synthetic construct
NMNGHDSPHKSGQNTH

SEQ ID NO: 2668 - protein, 16 aa, synthetic construct
IEMGHDSPHKSGQNQQ

SEQ ID NO: 2669 - protein, 16 aa, synthetic construct
TINGHDSPHKSGRRRQ

SEQ ID NO: 2670 - protein, 16 aa, synthetic construct
ISNGHDSPHKSAQNQQ

SEQ ID NO: 2671 - protein, 16 aa, synthetic construct
TGNGHDSPHKSGQYQQ

SEQ ID NO: 2672 - protein, 16 aa, synthetic construct
TINGNYSPHKIGQNQQ

SEQ ID NO: 2673 - protein, 16 aa, synthetic construct
TINGHDSPHKSRQNDQ

SEQ ID NO: 2674 - protein, 16 aa, synthetic construct
QQQGHDSPHKSGQNQQ

SEQ ID NO: 2675 - protein, 16 aa, synthetic construct
HDWGHDSPHKSGQNQQ

SEQ ID NO: 2676 - protein, 16 aa, synthetic construct
IEGGHDSPHKSGQNQQ

SEQ ID NO: 2677 - protein, 16 aa, synthetic construct
TFNRSGSPHSKAQNQQ

SEQ ID NO: 2678 - protein, 16 aa, synthetic construct
AINGHDSPHKSGQIRQ

SEQ ID NO: 2679 - protein, 16 aa, synthetic construct
TINGHDSPHKIGQNQH

SEQ ID NO: 2680 - protein, 16 aa, synthetic construct
AINGYDSPHKSGQKQQ

SEQ ID NO: 2681 - protein, 16 aa, synthetic construct
TESGHDSPHKSGQNQQ

SEQ ID NO: 2682 - protein, 16 aa, synthetic construct
TINGHDSPHKSGQSVQ

SEQ ID NO: 2683 - protein, 16 aa, synthetic construct
TINGHESPHKSGRSQQ

SEQ ID NO: 2684 - protein, 16 aa, synthetic construct
TINGHDSPHKSGQNKL

SEQ ID NO: 2685 - protein, 16 aa, synthetic construct
TINGHDSPHKTGQNQQ

SEQ ID NO: 2686 - protein, 16 aa, synthetic construct
TINGRGSPHKRGQNQQ

SEQ ID NO: 2687 - protein, 16 aa, synthetic construct
TINGSGSPHTKAQNPP

SEQ ID NO: 2688 - protein, 16 aa, synthetic construct
TINGQDSPHKSGQHQQ

SEQ ID NO: 2689 - protein, 16 aa, synthetic construct
SINGHDSPHKSGQIQH

SEQ ID NO: 2690 - protein, 16 aa, synthetic construct
AINGHDSPHKSGPRQQ

SEQ ID NO: 2691 - protein, 16 aa, synthetic construct
TVNGHDSPHKSGHTQQ

SEQ ID NO: 2692 - protein, 16 aa, synthetic construct
SINGHDSPHKSGQRQH

SEQ ID NO: 2693 - protein, 16 aa, synthetic construct
SLNGSGSPHTKAQNQQ

SEQ ID NO: 2694 - protein, 16 aa, synthetic construct
AINGHDSPHKSAQSQQ

SEQ ID NO: 2695 - protein, 16 aa, synthetic construct
SIYGHESPHKSGQNQQ

SEQ ID NO: 2696 - protein, 16 aa, synthetic construct
TVNGHDSPHKSLQNQQ

SEQ ID NO: 2697 - protein, 16 aa, synthetic construct
TINGHGSPHSKAQNPQ

SEQ ID NO: 2698 - protein, 16 aa, synthetic construct
TSNGYDSPHKSGQKQQ

SEQ ID NO: 2699 - protein, 16 aa, synthetic construct
TVNGHDSPHKSGRNQE

SEQ ID NO: 2700 - protein, 16 aa, synthetic construct
TTNGHDSPHKSGQTQL

SEQ ID NO: 2701 - protein, 16 aa, synthetic construct
AINGHDSPHKSEKNQQ

SEQ ID NO: 2702 - protein, 16 aa, synthetic construct
IINGRDSPHKSGQDQQ

SEQ ID NO: 2703 - protein, 16 aa, synthetic construct
TISGHDSPHKTGHNQQ

SEQ ID NO: 2704 - protein, 16 aa, synthetic construct
SINGYDSPHKSGQTQQ

SEQ ID NO: 2705 - protein, 16 aa, synthetic construct
TINGHESPHKSGQTQQ

SEQ ID NO: 2706 - protein, 16 aa, synthetic construct
TINGHDSPHKSGQSKQ

SEQ ID NO: 2707 - protein, 16 aa, synthetic construct
AIIGHESPHKSGQNQQ

SEQ ID NO: 2708 - protein, 16 aa, synthetic construct
TINGHDSPHKTGQNQP

SEQ ID NO: 2709 - protein, 16 aa, synthetic construct
AINGHDSPHKSGQSPQ

SEQ ID NO: 2710 - protein, 16 aa, synthetic construct
TIKGNDSPHKSVQNQQ

SEQ ID NO: 2711 - protein, 16 aa, synthetic construct
TEFGHDSPHKSGQNQQ

SEQ ID NO: 2712 - protein, 16 aa, synthetic construct
TINGHDSPHKSAQNYQ

SEQ ID NO: 2713 - protein, 16 aa, synthetic construct
TFNGSASPHSKALNQQ

SEQ ID NO: 2714 - protein, 16 aa, synthetic construct
TINGHESPHKSAQNRQ

SEQ ID NO: 2715 - protein, 16 aa, synthetic construct
TTNGHDSPHKSGQNQQ

SEQ ID NO: 2716 - protein, 16 aa, synthetic construct
TIKGQDSPHKIGQNQQ

SEQ ID NO: 2717 - protein, 16 aa, synthetic construct
TVNGHDSPHKSGQNHL

SEQ ID NO: 2718 - protein, 16 aa, synthetic construct
SINGHDSPHKSGQYQH

SEQ ID NO: 2719 - protein, 16 aa, synthetic construct
TINGNDSPHKSVQNHQ

SEQ ID NO: 2720 - protein, 16 aa, synthetic construct
TITGHDSPHKSGQNQW

SEQ ID NO: 2721 - protein, 16 aa, synthetic construct
TNNGHDSPHKSVQNQH

SEQ ID NO: 2722 - protein, 16 aa, synthetic construct
TIDGHDSPHKSGQNQH

SEQ ID NO: 2723 - protein, 16 aa, synthetic construct
TVNGHDSPHKSGQTRQ

SEQ ID NO: 2724 - protein, 16 aa, synthetic construct
TVNGHDSPHKSGQNLH

SEQ ID NO: 2725 - protein, 16 aa, synthetic construct
AISGHDSPHKSGLNQQ

SEQ ID NO: 2726 - protein, 16 aa, synthetic construct
AINGHDSPHKSAQNQE

SEQ ID NO: 2727 - protein, 16 aa, synthetic construct
TITGHDSPHKSGQHLQ

SEQ ID NO: 2728 - protein, 16 aa, synthetic construct
TINGHDSPHKSRLNQP

SEQ ID NO: 2729 - protein, 16 aa, synthetic construct
TVDGHDSPHKSGQKQQ

SEQ ID NO: 2730 - protein, 16 aa, synthetic construct
TINGQDSPHKSGQNQD

SEQ ID NO: 2731 - protein, 16 aa, synthetic construct
TIEGHDSPHKSGRNQQ

SEQ ID NO: 2732 - protein, 16 aa, synthetic construct
TTNGHDSPHKSGQNLL

SEQ ID NO: 2733 - protein, 16 aa, synthetic construct
TINGHDSPHKSGQLVI

SEQ ID NO: 2734 - protein, 16 aa, synthetic construct
TVNGHDSPHKSRQSQQ

SEQ ID NO: 2735 - protein, 16 aa, synthetic construct
TINGHDSPHKSGRTQE

SEQ ID NO: 2736 - protein, 16 aa, synthetic construct
TINGHDSPHKSVQTHQ

SEQ ID NO: 2737 - protein, 16 aa, synthetic construct
TSNGHDSPHKSGQNQP

SEQ ID NO: 2738 - protein, 16 aa, synthetic construct
VINGHDSPHKSGQTQQ

SEQ ID NO: 2739 - protein, 16 aa, synthetic construct
TINGPDSPHKIGQNQQ

SEQ ID NO: 2740 - protein, 16 aa, synthetic construct
AVNGHDSPHKSVQNQQ

SEQ ID NO: 2741 - protein, 16 aa, synthetic construct
TINGHDSPHKSRQDQH

SEQ ID NO: 2742 - protein, 16 aa, synthetic construct
AINGPDSPHKSGQKQQ

SEQ ID NO: 2743 - protein, 16 aa, synthetic construct
TINGHDSPHKSRQSQH

SEQ ID NO: 2744 - protein, 16 aa, synthetic construct
TIYGHDSPHKSVQNQL

SEQ ID NO: 2745 - protein, 16 aa, synthetic construct
TVNGHDSPHKSGQNLL

SEQ ID NO: 2746 - protein, 16 aa, synthetic construct
TENKSGSPHSKAQNQQ

SEQ ID NO: 2747 - protein, 16 aa, synthetic construct
TTNGQDSPHKSGQNQQ

SEQ ID NO: 2748 - protein, 16 aa, synthetic construct
TDKGSGSPHSKAQNQQ

SEQ ID NO: 2749 - protein, 16 aa, synthetic construct
TIDGHDSPHKSGRNQQ

SEQ ID NO: 2750 - protein, 16 aa, synthetic construct
TINGYDSPHKSGQYQH

SEQ ID NO: 2751 - protein, 16 aa, synthetic construct
TDNGHDSPHKSRQNQQ

SEQ ID NO: 2752 - protein, 16 aa, synthetic construct
TINGHDSPHKSWVRQQ

SEQ ID NO: 2753 - protein, 16 aa, synthetic construct
TINGHESPHKSGQNQH

SEQ ID NO: 2754 - protein, 16 aa, synthetic construct
TVNGHDSPHKIGHNQQ

SEQ ID NO: 2755 - protein, 16 aa, synthetic construct
TCNGHDSPHKSGRNQQ

SEQ ID NO: 2756 - protein, 16 aa, synthetic construct
TINGNGSPHSKAQNHQ

SEQ ID NO: 2757 - protein, 16 aa, synthetic construct
NVVGHDSPHKSGQNQQ

SEQ ID NO: 2758 - protein, 16 aa, synthetic construct
TINGHDSPHKSNAWQQ

SEQ ID NO: 2759 - protein, 16 aa, synthetic construct
TDAGHDSPHKSGQNQQ

SEQ ID NO: 2760 - protein, 16 aa, synthetic construct
TEVGHDSPHKSGQNQQ

SEQ ID NO: 2761 - protein, 16 aa, synthetic construct
SELGHDSPHKSGQNQQ

SEQ ID NO: 2762 - protein, 16 aa, synthetic construct
TINGHDSPHKSGQSVP

SEQ ID NO: 2763 - protein, 16 aa, synthetic construct
TINGHESPHKSGQNIQ

SEQ ID NO: 2764 - protein, 16 aa, synthetic construct
TINGHDSPHKSVQNHL

SEQ ID NO: 2765 - protein, 16 aa, synthetic construct
TINGHDSPHKIGLDQQ

SEQ ID NO: 2766 - protein, 16 aa, synthetic construct
TSNASGSPHSKAQHQQ

SEQ ID NO: 2767 - protein, 16 aa, synthetic construct
TINGHDSPHKRGPDQQ

SEQ ID NO: 2768 - protein, 16 aa, synthetic construct
TINGMGSPHSKTQNQQ

SEQ ID NO: 2769 - protein, 16 aa, synthetic construct
TIKGHDSPHKSGESQQ

SEQ ID NO: 2770 - protein, 16 aa, synthetic construct
TINGHDSPHKHGQNHQ

SEQ ID NO: 2771 - protein, 16 aa, synthetic construct
TVNGTGSPHSKAQNQL

SEQ ID NO: 2772 - protein, 16 aa, synthetic construct
TIIGHDSPHKSGQYQH

SEQ ID NO: 2773 - protein, 16 aa, synthetic construct
TSNGHDSPHKSVQNKQ

SEQ ID NO: 2774 - protein, 16 aa, synthetic construct
IVNGQVSPHKSGQNQQ

SEQ ID NO: 2775 - protein, 16 aa, synthetic construct
TVNGHDSPHKSGQRQL

SEQ ID NO: 2776 - protein, 16 aa, synthetic construct
TVNGHDSPHKIGQNQL

SEQ ID NO: 2777 - protein, 16 aa, synthetic construct
TINGHDSPHKSGQIIV

SEQ ID NO: 2778 - protein, 16 aa, synthetic construct
IGNGHESPHKSGQNQQ

SEQ ID NO: 2779 - protein, 16 aa, synthetic construct
EVMGHDSPHKSGQNQQ

SEQ ID NO: 2780 - protein, 16 aa, synthetic construct
TINGYDSPHKSGQKQS

SEQ ID NO: 2781 - protein, 16 aa, synthetic construct
TIHGNGSPHSKAQNQE

SEQ ID NO: 2782 - protein, 16 aa, synthetic construct
YQVGHDSPHKSGQNQQ

SEQ ID NO: 2783 - protein, 16 aa, synthetic construct
TIKGDDSPHKSVQNQQ

SEQ ID NO: 2784 - protein, 16 aa, synthetic construct
TINGHDSPHKSVQSHQ

SEQ ID NO: 2785 - protein, 16 aa, synthetic construct
TINGHDSPHKSGQFVV

SEQ ID NO: 2786 - protein, 16 aa, synthetic construct
TVNGHDSPHKSRQNLQ

SEQ ID NO: 2787 - protein, 16 aa, synthetic construct
ATNGHNSPHKSGQNQE

SEQ ID NO: 2788 - protein, 16 aa, synthetic construct
AINGHDSPHKSAQNQQ

SEQ ID NO: 2789 - protein, 16 aa, synthetic construct
TEHGHDSPHKSGQNQQ

SEQ ID NO: 2790 - protein, 16 aa, synthetic construct
TIYGHDSPHKSGQSQP

SEQ ID NO: 2791 - protein, 16 aa, synthetic construct
TISGHESPHKSGQNEQ

SEQ ID NO: 2792 - protein, 16 aa, synthetic construct
AIIGHDSPHKSAQNQQ

SEQ ID NO: 2793 - protein, 16 aa, synthetic construct
AIDGHDSPHKSGQNQL

SEQ ID NO: 2794 - protein, 16 aa, synthetic construct
TIMGHDSPHKSVQNQQ

SEQ ID NO: 2795 - protein, 16 aa, synthetic construct
EVGGHDSPHKSGQNQQ

SEQ ID NO: 2796 - protein, 16 aa, synthetic construct
TINGHDSPHKSAQNLL

SEQ ID NO: 2797 - protein, 16 aa, synthetic construct
TINASGSPHSKAINQQ

SEQ ID NO: 2798 - protein, 16 aa, synthetic construct
AINGNGSPHKRGQNQQ

SEQ ID NO: 2799 - protein, 16 aa, synthetic construct
SEMGHDSPHKSGQNQQ

SEQ ID NO: 2800 - protein, 16 aa, synthetic construct
AQQGHDSPHKSGQNQQ

SEQ ID NO: 2801 - protein, 16 aa, synthetic construct
AINGHDSPHKSGQSLQ

SEQ ID NO: 2802 - protein, 16 aa, synthetic construct
TINGSGSPHSKAPNQQ

SEQ ID NO: 2803 - protein, 16 aa, synthetic construct
CGEGHDSPHKSGQNQQ

SEQ ID NO: 2804 - protein, 16 aa, synthetic construct
TVNGHDSPHKSAQNHQ

SEQ ID NO: 2805 - protein, 16 aa, synthetic construct
TVNGHDSPHKSGQTQL

SEQ ID NO: 2806 - protein, 16 aa, synthetic construct
TNNGHDSPHKSGRNRQ

SEQ ID NO: 2807 - protein, 16 aa, synthetic construct
TINGHDSPHKYGQNEQ

SEQ ID NO: 2808 - protein, 16 aa, synthetic construct
TINGNGSPHSKAPNLQ

SEQ ID NO: 2809 - protein, 16 aa, synthetic construct
SINGHDSPHKSQQNQQ

SEQ ID NO: 2810 - protein, 16 aa, synthetic construct
TIGGHDSPHKSGQNQQ

SEQ ID NO: 2811 - protein, 16 aa, synthetic construct
TINGHDSPHKSVQSKQ

SEQ ID NO: 2812 - protein, 16 aa, synthetic construct
ELVGHDSPHKSGQNQQ

SEQ ID NO: 2813 - protein, 16 aa, synthetic construct
ELMGHDSPHKSGQNQQ

SEQ ID NO: 2814 - protein, 16 aa, synthetic construct
TINGNDSPHKIGHNQQ

SEQ ID NO: 2815 - protein, 16 aa, synthetic construct
TIKGGGSPHSKAQDQQ

SEQ ID NO: 2816 - protein, 16 aa, synthetic construct
TVNGHDSPHKSGQTQQ

SEQ ID NO: 2817 - protein, 16 aa, synthetic construct
TINGQDSPHKSGQNPL

SEQ ID NO: 2818 - protein, 16 aa, synthetic construct
TVNASGSPHSKAQNHQ

SEQ ID NO: 2819 - protein, 16 aa, synthetic construct
TINGHDSPHKSGRDQK

SEQ ID NO: 2820 - protein, 16 aa, synthetic construct
TINGHDSPHKSVHNQQ

SEQ ID NO: 2821 - protein, 16 aa, synthetic construct
TINGHDSPHKSGQWKR

SEQ ID NO: 2822 - protein, 16 aa, synthetic construct
TIDGSGSPHSKAENRQ

SEQ ID NO: 2823 - protein, 16 aa, synthetic construct
NEIGHDSPHKSGQNQQ

SEQ ID NO: 2824 - protein, 16 aa, synthetic construct
AINGHDSPHKSGQSQQ

SEQ ID NO: 2825 - protein, 16 aa, synthetic construct
IINGHDSPHKSRQAQQ

SEQ ID NO: 2826 - protein, 16 aa, synthetic construct
TPNGHDSPHKSGQNQQ

SEQ ID NO: 2827 - protein, 16 aa, synthetic construct
ITNGHDSPHKSGQTQQ

SEQ ID NO: 2828 - protein, 16 aa, synthetic construct
TINGHDSPHKSVQNHQ

SEQ ID NO: 2829 - protein, 16 aa, synthetic construct
TINGHDSPHKSKQNQQ

SEQ ID NO: 2830 - protein, 16 aa, synthetic construct
TINGHDSPHKSAQNQL

SEQ ID NO: 2831 - protein, 16 aa, synthetic construct
TVNGHDSPHKSGQTQP

SEQ ID NO: 2832 - protein, 16 aa, synthetic construct
TDQGHDSPHKSGQNQQ

SEQ ID NO: 2833 - protein, 16 aa, synthetic construct
TINGHDSPHKLWINQQ

SEQ ID NO: 2834 - protein, 16 aa, synthetic construct
GINGPDSPHKSGQNQQ

SEQ ID NO: 2835 - protein, 16 aa, synthetic construct
SEIGHDSPHKSGQNQQ

SEQ ID NO: 2836 - protein, 16 aa, synthetic construct
TINGHDSPHKSVQKQL

SEQ ID NO: 2837 - protein, 16 aa, synthetic construct
TINGHPSPHWKGQNQQ

SEQ ID NO: 2838 - protein, 16 aa, synthetic construct
TVNGHDSPHKSGRNQL

SEQ ID NO: 2839 - protein, 16 aa, synthetic construct
TIKGSGSPHSKVQDQQ

SEQ ID NO: 2840 - protein, 16 aa, synthetic construct
SEKGHDSPHKSGQNQQ

SEQ ID NO: 2841 - protein, 16 aa, synthetic construct
WSAGHDSPHKSGQNQQ

SEQ ID NO: 2842 - protein, 16 aa, synthetic construct
ELAGHDSPHKSGQNQQ

SEQ ID NO: 2843 - protein, 16 aa, synthetic construct
TINGHDSPHKMGRNQQ

SEQ ID NO: 2844 - protein, 16 aa, synthetic construct
TINGHDSPHKSGISIQ

SEQ ID NO: 2845 - protein, 16 aa, synthetic construct
TSNGHDSPHKSVQNLQ

SEQ ID NO: 2846 - protein, 16 aa, synthetic construct
QTQGHDSPHKSGQNQQ

SEQ ID NO: 2847 - protein, 16 aa, synthetic construct
TINGHDSPHKMAHNQQ

SEQ ID NO: 2848 - protein, 16 aa, synthetic construct
AINGSGSPHSKAQTQQ

SEQ ID NO: 2849 - protein, 16 aa, synthetic construct
TINGHDSPHKHGQNQQ

SEQ ID NO: 2850 - protein, 16 aa, synthetic construct
GADGHDSPHKSGQNQQ

SEQ ID NO: 2851 - protein, 16 aa, synthetic construct
VGEGHDSPHKSGQNQQ

SEQ ID NO: 2852 - protein, 16 aa, synthetic construct
ANEGHDSPHKSGQNQQ

SEQ ID NO: 2853 - protein, 16 aa, synthetic construct
TEAKSGSPHSKAQNQQ

SEQ ID NO: 2854 - protein, 16 aa, synthetic construct
TINGHDSPHKSVQSQQ

SEQ ID NO: 2855 - protein, 16 aa, synthetic construct
TIPGSGSPHSKAQNLQ

SEQ ID NO: 2856 - protein, 16 aa, synthetic construct
TINGHDSPHKSGQTVC

SEQ ID NO: 2857 - protein, 16 aa, synthetic construct
ELRGHDSPHKSGQNQQ

SEQ ID NO: 2858 - protein, 16 aa, synthetic construct
CQIGHDSPHKSGQNQQ

SEQ ID NO: 2859 - protein, 16 aa, synthetic construct
GVMGHDSPHKSGQNQQ

SEQ ID NO: 2860 - protein, 16 aa, synthetic construct
ACDGHDSPHKSGQNQQ

SEQ ID NO: 2861 - protein, 16 aa, synthetic construct
TINGQDSPHKSGQYQQ

SEQ ID NO: 2862 - protein, 16 aa, synthetic construct
TINGHDSPHKSGQQIM

SEQ ID NO: 2863 - protein, 16 aa, synthetic construct
TINGHDSPHKSRQNEQ

SEQ ID NO: 2864 - protein, 16 aa, synthetic construct
ASNGHDSPHKSGLNHQ

SEQ ID NO: 2865 - protein, 16 aa, synthetic construct
TVNGHDSPHKSGQSQP

SEQ ID NO: 2866 - protein, 16 aa, synthetic construct
NELGHDSPHKSGQNQQ

SEQ ID NO: 2867 - protein, 16 aa, synthetic construct
AAEGHDSPHKSGQNQQ

SEQ ID NO: 2868 - protein, 16 aa, synthetic construct
GQNGHDSPHKSGQNQQ

SEQ ID NO: 2869 - protein, 16 aa, synthetic construct
NEFGHDSPHKSGQNQQ

SEQ ID NO: 2870 - protein, 16 aa, synthetic construct
TSIGYDSPHKSGQNQQ

SEQ ID NO: 2871 - protein, 16 aa, synthetic construct
TDNGHDSPHKSGQNLQ

SEQ ID NO: 2872 - protein, 16 aa, synthetic construct
TITGHDSPHKSRQDQQ

SEQ ID NO: 2873 - protein, 16 aa, synthetic construct
AEHGHDSPHKSGQNQQ

SEQ ID NO: 2874 - protein, 16 aa, synthetic construct
TINGDDSPHKSGQKQL

SEQ ID NO: 2875 - protein, 16 aa, synthetic construct
EILGHDSPHKSGQNQQ

SEQ ID NO: 2876 - protein, 16 aa, synthetic construct
TIHGSGSPHSKAQNQA

SEQ ID NO: 2877 - protein, 16 aa, synthetic construct
AINGDDSPHKSGHNQQ

SEQ ID NO: 2878 - protein, 16 aa, synthetic construct
TSNGHNSPHKSGQNQE

SEQ ID NO: 2879 - protein, 16 aa, synthetic construct
TINGHDSPHKSGQMIH

SEQ ID NO: 2880 - protein, 16 aa, synthetic construct
NAIGHDSPHKSGQNQQ

SEQ ID NO: 2881 - protein, 16 aa, synthetic construct
VINGHDSPHKSGRNHQ

SEQ ID NO: 2882 - protein, 16 aa, synthetic construct
TITGHDSPHKSVQNRQ

SEQ ID NO: 2883 - protein, 16 aa, synthetic construct
TINGHDSPHKSGQKMN

SEQ ID NO: 2884 - protein, 16 aa, synthetic construct
TIHGHDSPHKSGQSQQ

SEQ ID NO: 2885 - protein, 16 aa, synthetic construct
TEIGHDSPHKSGQNQQ

SEQ ID NO: 2886 - protein, 16 aa, synthetic construct
TINGHDSPHKSGQYQH

SEQ ID NO: 2887 - protein, 14 aa, synthetic construct
GSGSPHSKAQNRHT

SEQ ID NO: 2888 - protein, 14 aa, synthetic construct
GSGSPHSKVQNQQT

SEQ ID NO: 2889 - protein, 14 aa, synthetic construct
MSGSPHSKAQNQQT

SEQ ID NO: 2890 - protein, 14 aa, synthetic construct
GSGSPHSKARDQQT

SEQ ID NO: 2891 - protein, 14 aa, synthetic construct
GSGSPHSKAPNLQT

SEQ ID NO: 2892 - protein, 14 aa, synthetic construct
TSGSPHSKAQNQQT

SEQ ID NO: 2893 - protein, 14 aa, synthetic construct
GSGSPHSKAHVRQT

SEQ ID NO: 2894 - protein, 14 aa, synthetic construct
GSGSPHSKAPNQHT

SEQ ID NO: 2895 - protein, 14 aa, synthetic construct
ISGSPHSKAQNQQT

SEQ ID NO: 2896 - protein, 14 aa, synthetic construct
GSGSPHSKTQSQQT

SEQ ID NO: 2897 - skipped

SEQ ID NO: 2898 - protein, 14 aa, synthetic construct
ESGSPHSKAQNQQI

SEQ ID NO: 2899 - protein, 14 aa, synthetic construct
GSGSPHSKAQPAKT

SEQ ID NO: 2900 - protein, 14 aa, synthetic construct
SSGSPHSKAQNQQT

SEQ ID NO: 2901 - protein, 14 aa, synthetic construct
GSGSPHSKSQTQQN

SEQ ID NO: 2902 - protein, 14 aa, synthetic construct
ASGSPHSKAQNQQT

SEQ ID NO: 2903 - protein, 14 aa, synthetic construct
GSGSPHSKAQNLAT

SEQ ID NO: 2904 - protein, 14 aa, synthetic construct
GSGSPHSKSQNQLT

SEQ ID NO: 2905 - protein, 14 aa, synthetic construct
NSGSPHSKAQNQQT

SEQ ID NO: 2906 - protein, 14 aa, synthetic construct
GSGSPHSKAQGQQT

SEQ ID NO: 2907 - protein, 14 aa, synthetic construct
VSGSPHSKAQNQQT

SEQ ID NO: 2908 - protein, 14 aa, synthetic construct
GSGSPHSKALNRQS

SEQ ID NO: 2909 - protein, 14 aa, synthetic construct
LSGSPHSKAQNQQT

SEQ ID NO: 2910 - protein, 14 aa, synthetic construct
GSGSPHSKAHNQQT

SEQ ID NO: 2911 - protein, 14 aa, synthetic construct
GSGSPHSKTQNQQT

SEQ ID NO: 2912 - protein, 14 aa, synthetic construct
GSGSPHSKAQNPPT

SEQ ID NO: 2913 - protein, 14 aa, synthetic construct
GSGSPHSKAQNLQT

SEQ ID NO: 2914 - protein, 14 aa, synthetic construct
GSGSPHSKAQYQQT

SEQ ID NO: 2915 - protein, 14 aa, synthetic construct
GSGSPHSKAQDQET

SEQ ID NO: 2916 - protein, 14 aa, synthetic construct
KSGSPHSKAQNQQT

SEQ ID NO: 2917 - protein, 14 aa, synthetic construct
GSGSPHSKAQNHQT

SEQ ID NO: 2918 - protein, 14 aa, synthetic construct
GSGSPHSKAQDQQT

SEQ ID NO: 2919 - protein, 14 aa, synthetic construct
GSGSPHSKGHWQQT

SEQ ID NO: 2920 - protein, 14 aa, synthetic construct
GSGSPHSKAPNQQT

SEQ ID NO: 2921 - protein, 14 aa, synthetic construct
GSGSPHSKAQNQLI

SEQ ID NO: 2922 - protein, 14 aa, synthetic construct
GSGSPHSKRPEQQT

SEQ ID NO: 2923 - protein, 14 aa, synthetic construct
GSGSPHSKAQRTMT

SEQ ID NO: 2924 - protein, 14 aa, synthetic construct
GSGSPHSKAQNQQH

SEQ ID NO: 2925 - protein, 14 aa, synthetic construct
HSGSPHSKAQNQQT

SEQ ID NO: 2926 - protein, 14 aa, synthetic construct
GSGSPHSKALHQHT

SEQ ID NO: 2927 - protein, 14 aa, synthetic construct
GSGSPHSKAQHRIT

SEQ ID NO: 2928 - protein, 14 aa, synthetic construct
GSGSPHSKAQYIHT

SEQ ID NO: 2929 - protein, 14 aa, synthetic construct
GSGSPHSKAQKFET

SEQ ID NO: 2930 - protein, 14 aa, synthetic construct
ESGSPHSKAQNHQT

SEQ ID NO: 2931 - protein, 14 aa, synthetic construct
GSGSPHSKAQFPST

SEQ ID NO: 2932 - protein, 14 aa, synthetic construct
PSGSPHSKAQNQQT

SEQ ID NO: 2933 - protein, 14 aa, synthetic construct
GSGSPHSKAHNQQR

SEQ ID NO: 2934 - protein, 14 aa, synthetic construct
GSGSPHSKAQAIKT

SEQ ID NO: 2935 - protein, 14 aa, synthetic construct
GSGSPHSKGQNRQT

SEQ ID NO: 2936 - protein, 14 aa, synthetic construct
GSGSPHSKAQSQQT

SEQ ID NO: 2937 - protein, 14 aa, synthetic construct
ASGSPHSKAQNQLT

SEQ ID NO: 2938 - protein, 14 aa, synthetic construct
RSGSPHSKAQNQQT

SEQ ID NO: 2939 - protein, 14 aa, synthetic construct
GSGSPHSKAQYQHT

SEQ ID NO: 2940 - protein, 14 aa, synthetic construct
GSGSPHTKAQNPQS

SEQ ID NO: 2941 - protein, 14 aa, synthetic construct
GSGSPHSKGQNPPT

SEQ ID NO: 2942 - protein, 14 aa, synthetic construct
GSGSPHSKAQHQLT

SEQ ID NO: 2943 - protein, 14 aa, synthetic construct
GSGSPHSKAQSPPT

SEQ ID NO: 2944 - protein, 14 aa, synthetic construct
GSGSPHSKAQAKLT

SEQ ID NO: 2945 - protein, 14 aa, synthetic construct
GSGSPHSKTKSQQT

SEQ ID NO: 2946 - protein, 14 aa, synthetic construct
GSGSPHSKAQDRPT

SEQ ID NO: 2947 - protein, 14 aa, synthetic construct
GSGSPHSKAQSQQL

SEQ ID NO: 2948 - protein, 14 aa, synthetic construct
GSGSPHSKAQAFHT

SEQ ID NO: 2949 - protein, 14 aa, synthetic construct
GSGSPHSKAQKQQD

SEQ ID NO: 2950 - protein, 14 aa, synthetic construct
GSGSPHSKAQNAQT

SEQ ID NO: 2951 - protein, 14 aa, synthetic construct
WSGSPHSKAQNQQT

SEQ ID NO: 2952 - protein, 14 aa, synthetic construct
GSGSPHSKAHNQLT

SEQ ID NO: 2953 - protein, 14 aa, synthetic construct
GSGSPHSKAQNQQY

SEQ ID NO: 2954 - protein, 14 aa, synthetic construct
GSGSPHSKAQKLNT

SEQ ID NO: 2955 - protein, 14 aa, synthetic construct
GSGSPHSKSQNVQT

SEQ ID NO: 2956 - protein, 14 aa, synthetic construct
GSGSPHSKAQAQQT

SEQ ID NO: 2957 - protein, 14 aa, synthetic construct
GSGSPHSKAQNLQA

SEQ ID NO: 2958 - protein, 14 aa, synthetic construct
DSGSPHSKAQNQQT

SEQ ID NO: 2959 - protein, 14 aa, synthetic construct
ASGSPHSKAPNQQT

SEQ ID NO: 2960 - protein, 14 aa, synthetic construct
GSGSPHSKAQTPPT

SEQ ID NO: 2961 - protein, 14 aa, synthetic construct
GSGSPHSKAQYQHA

SEQ ID NO: 2962 - protein, 14 aa, synthetic construct
GSGSPHSKAQGQQA

SEQ ID NO: 2963 - protein, 14 aa, synthetic construct
GSGSPHNKAQNHQT

SEQ ID NO: 2964 - protein, 14 aa, synthetic construct
GSGSPHSKAQPPAT

SEQ ID NO: 2965 - protein, 14 aa, synthetic construct
GSGSPHSKAQERPT

SEQ ID NO: 2966 - protein, 14 aa, synthetic construct
GSGSPHSKAQDLQT

SEQ ID NO: 2967 - protein, 14 aa, synthetic construct
GSGSPHSKAQAMHT

SEQ ID NO: 2968 - protein, 14 aa, synthetic construct
GSGSPHSKALNQQT

SEQ ID NO: 2969 - protein, 14 aa, synthetic construct
GSGSPHSKAQHPST

SEQ ID NO: 2970 - protein, 14 aa, synthetic construct
GSGSPHSKAPGLQT

SEQ ID NO: 2971 - protein, 14 aa, synthetic construct
GSGSPHSKAQGIRT

SEQ ID NO: 2972 - protein, 14 aa, synthetic construct
GSGSPHSKAQAPAT

SEQ ID NO: 2973 - protein, 14 aa, synthetic construct
GSGSPHSKSQSQQI

SEQ ID NO: 2974 - protein, 14 aa, synthetic construct
GSGSPHSKAQIPPT

SEQ ID NO: 2975 - protein, 14 aa, synthetic construct
GSGSPHSKAQTQLT

SEQ ID NO: 2976 - protein, 14 aa, synthetic construct
GSGSPHSKAQAPST

SEQ ID NO: 2977 - protein, 14 aa, synthetic construct
GSGSPHSKGQNQQT

SEQ ID NO: 2978 - protein, 14 aa, synthetic construct
ASGSPHSKAHNQQT

SEQ ID NO: 2979 - protein, 14 aa, synthetic construct
GSGSPHSKAQNTYA

SEQ ID NO: 2980 - protein, 14 aa, synthetic construct
GSGSPHSKSQNQHI

SEQ ID NO: 2981 - protein, 14 aa, synthetic construct
GSGSPHSKAQNHLT

SEQ ID NO: 2982 - protein, 14 aa, synthetic construct
GSGSPHSKAQIGMT

SEQ ID NO: 2983 - protein, 14 aa, synthetic construct
GSGSPHSKALNKQT

SEQ ID NO: 2984 - protein, 14 aa, synthetic construct
GSGSPHSKAQLQQT

SEQ ID NO: 2985 - protein, 14 aa, synthetic construct
GSGSPHSKAQRMST

SEQ ID NO: 2986 - protein, 14 aa, synthetic construct
GSGSPHSKAQGILT

SEQ ID NO: 2987 - protein, 14 aa, synthetic construct
GSGSPHSKAQDRQT

SEQ ID NO: 2988 - protein, 14 aa, synthetic construct
GSGSPHSKARDWQT

SEQ ID NO: 2989 - protein, 14 aa, synthetic construct
GSGSPHSKAQNTHD

SEQ ID NO: 2990 - protein, 14 aa, synthetic construct
GSGSPHSKAPNLQI

SEQ ID NO: 2991 - protein, 14 aa, synthetic construct
GSGSPHSKAQERST

SEQ ID NO: 2992 - protein, 14 aa, synthetic construct
GSGSPHSKAQNYQT

SEQ ID NO: 2993 - protein, 14 aa, synthetic construct
GSGSPHSKAQRTCT

SEQ ID NO: 2994 - protein, 14 aa, synthetic construct
GSGSPHSKAQIGHT

SEQ ID NO: 2995 - protein, 14 aa, synthetic construct
GSGSPHSKAQGAIT

SEQ ID NO: 2996 - protein, 14 aa, synthetic construct
GSGSPHSKAQVPPT

SEQ ID NO: 2997 - protein, 14 aa, synthetic construct
GSGSPHSKAQVQQI

SEQ ID NO: 2998 - protein, 14 aa, synthetic construct
GSGSPHSKALMRQT

SEQ ID NO: 2999 - protein, 14 aa, synthetic construct
GSGSPHSKAQYSVT

SEQ ID NO: 3000 - protein, 14 aa, synthetic construct
GSGSPHSKVPNLQT

SEQ ID NO: 3001 - protein, 14 aa, synthetic construct
GSGSPHSKAQSQQI

SEQ ID NO: 3002 - protein, 14 aa, synthetic construct
GSGSPHSKAQAITT

SEQ ID NO: 3003 - protein, 14 aa, synthetic construct
GSGSPHSKAQKTLT

SEQ ID NO: 3004 - protein, 14 aa, synthetic construct
GSGSPHSKAQNQWT

SEQ ID NO: 3005 - protein, 14 aa, synthetic construct
GSGSPHSKAQLHHT

SEQ ID NO: 3006 - protein, 14 aa, synthetic construct
GSGSPHSKAQNIII

SEQ ID NO: 3007 - protein, 14 aa, synthetic construct
GSGSPHSKAQGHHT

SEQ ID NO: 3008 - protein, 14 aa, synthetic construct
GSGSPHSKAQSKVT

SEQ ID NO: 3009 - protein, 14 aa, synthetic construct
GSGSPHSKAQLPST

SEQ ID NO: 3010 - protein, 14 aa, synthetic construct
GSGSPHSKAIGKQT

SEQ ID NO: 3011 - protein, 14 aa, synthetic construct
GSGSPHSKAQAIHT

SEQ ID NO: 3012 - protein, 14 aa, synthetic construct
GSGSPHSKAQHGLT

SEQ ID NO: 3013 - protein, 14 aa, synthetic construct
GSGSPHSKAQFMCT

SEQ ID NO: 3014 - protein, 14 aa, synthetic construct
VSGSPHSKAQGQQT

SEQ ID NO: 3015 - protein, 14 aa, synthetic construct
GSGSPHSKAQHLQT

SEQ ID NO: 3016 - protein, 14 aa, synthetic construct
GSGSPHSKTQNHQN

SEQ ID NO: 3017 - protein, 14 aa, synthetic construct
GSGSPHSKAQPART

SEQ ID NO: 3018 - protein, 14 aa, synthetic construct
GSGSPHSKAQSLQT

SEQ ID NO: 3019 - protein, 14 aa, synthetic construct
GSGSPHSKSQSQLT

SEQ ID NO: 3020 - protein, 14 aa, synthetic construct
GSGSPHSKAQDRQS

SEQ ID NO: 3021 - protein, 14 aa, synthetic construct
GSGSPHSKAQMPST

SEQ ID NO: 3022 - protein, 14 aa, synthetic construct
GSGSPHSKAQGSLT

SEQ ID NO: 3023 - protein, 14 aa, synthetic construct
GSGSPHSKSQNQQT

SEQ ID NO: 3024 - protein, 14 aa, synthetic construct
GSGSPHSKAQVPAT

SEQ ID NO: 3025 - protein, 14 aa, synthetic construct
GSGSPHSKAQDKQT

SEQ ID NO: 3026 - protein, 14 aa, synthetic construct
GSGSPHSKAHYQQT

SEQ ID NO: 3027 - protein, 14 aa, synthetic construct
GSGSPHSKAQVPST

SEQ ID NO: 3028 - protein, 14 aa, synthetic construct
GSGSPHSKARGEQT

SEQ ID NO: 3029 - protein, 14 aa, synthetic construct
GSGSPHSKAPGQQT

SEQ ID NO: 3030 - protein, 14 aa, synthetic construct
GSGSPHSKAQSLQI

SEQ ID NO: 3031 - protein, 14 aa, synthetic construct
GSGSPHSKRLEQQT

SEQ ID NO: 3032 - protein, 14 aa, synthetic construct
GSGSPHSKAQNQST

SEQ ID NO: 3033 - protein, 14 aa, synthetic construct
GSGSPHSKAQKVIT

SEQ ID NO: 3034 - protein, 14 aa, synthetic construct
GSGSPHSKAQNNDQ

SEQ ID NO: 3035 - protein, 14 aa, synthetic construct
GSGSPHSKAQSVHT

SEQ ID NO: 3036 - protein, 14 aa, synthetic construct
GSGSPHSKAQPLGT

SEQ ID NO: 3037 - protein, 14 aa, synthetic construct
GSGSPHSKAHNQET

SEQ ID NO: 3038 - protein, 14 aa, synthetic construct
GSGSPHSKAQNLQI

SEQ ID NO: 3039 - protein, 14 aa, synthetic construct
GSGSPHSKAQIQQT

SEQ ID NO: 3040 - protein, 14 aa, synthetic construct
GSGSPHSKAQVRNT

SEQ ID NO: 3041 - protein, 14 aa, synthetic construct
GSGSPHSKAPSNQT

SEQ ID NO: 3042 - protein, 14 aa, synthetic construct
GSGSPHSKAQVGHT

SEQ ID NO: 3043 - protein, 14 aa, synthetic construct
GSGSPHSKAQRDIT

SEQ ID NO: 3044 - protein, 14 aa, synthetic construct
GSGSPHSKAQMPNT

SEQ ID NO: 3045 - protein, 14 aa, synthetic construct
GSGSPHSKARGLQT

SEQ ID NO: 3046 - protein, 14 aa, synthetic construct
GSGSPHSKLQKQQT

SEQ ID NO: 3047 - protein, 14 aa, synthetic construct
GSGSPHSKAPSLQT

SEQ ID NO: 3048 - protein, 14 aa, synthetic construct
GSGSPHSKAQRDQT

SEQ ID NO: 3049 - protein, 14 aa, synthetic construct
GSGSPHSKNRDQQT

SEQ ID NO: 3050 - protein, 14 aa, synthetic construct
GSGSPHSKAQAKGT

SEQ ID NO: 3051 - protein, 14 aa, synthetic construct
GSGSPHSKAQSAHT

SEQ ID NO: 3052 - protein, 14 aa, synthetic construct
GSGSPHSKSQNHQT

SEQ ID NO: 3053 - protein, 14 aa, synthetic construct
RSGSPHSKAQDQQT

SEQ ID NO: 3054 - protein, 14 aa, synthetic construct
GSGSPHSKAQSTMT

SEQ ID NO: 3055 - protein, 14 aa, synthetic construct
GSGSPHSKAQREMT

SEQ ID NO: 3056 - protein, 14 aa, synthetic construct
GSGSPHSKAQYRAT

SEQ ID NO: 3057 - protein, 14 aa, synthetic construct
GSGSPHSKNQWQQT

SEQ ID NO: 3058 - protein, 14 aa, synthetic construct
GSGSPHSKAQRMNT

SEQ ID NO: 3059 - protein, 14 aa, synthetic construct
GSGSPHAKAQNHQT

SEQ ID NO: 3060 - protein, 14 aa, synthetic construct
GSGSPHSKAGDSQT

SEQ ID NO: 3061 - protein, 14 aa, synthetic construct
GSGSPHSKLKSQQT

SEQ ID NO: 3062 - protein, 14 aa, synthetic construct
GSGSPHSKAQKIST

SEQ ID NO: 3063 - protein, 14 aa, synthetic construct
GSGSPHSKAPSMQT

SEQ ID NO: 3064 - protein, 14 aa, synthetic construct
GSGSPHSKASPRQT

SEQ ID NO: 3065 - protein, 14 aa, synthetic construct
GSGSPHSKRMEQQT

SEQ ID NO: 3066 - protein, 14 aa, synthetic construct
GSGSPHSKAQYQNT

SEQ ID NO: 3067 - protein, 14 aa, synthetic construct
RSGSPHSKAQNQQI

SEQ ID NO: 3068 - protein, 14 aa, synthetic construct
GSGSPHTKAQNPPT

SEQ ID NO: 3069 - protein, 14 aa, synthetic construct
GSGSPHTKAQNQQT

SEQ ID NO: 3070 - protein, 14 aa, synthetic construct
ASGSPHSKAQHQQT

SEQ ID NO: 3071 - protein, 14 aa, synthetic construct
ASGSPHSKAINQQT

SEQ ID NO: 3072 - protein, 14 aa, synthetic construct
GSGSPHSKAPNQQH

SEQ ID NO: 3073 - protein, 14 aa, synthetic construct
ASGSPHSKAQNHQT

SEQ ID NO: 3074 - protein, 14 aa, synthetic construct
GSGSPHSKAENRQT

SEQ ID NO: 3075 - protein, 14 aa, synthetic construct
GSGSPHSKVQDQQT

SEQ ID NO: 3076 - protein, 14 aa, synthetic construct
GSGSPHSKAQTQQA

SEQ ID NO: 3077 - protein, 14 aa, synthetic construct
GSGSPHSKAQNQAT

SEQ ID NO: 3078 - protein, 14 aa, synthetic construct
GHDSPHKSGQIRQT

SEQ ID NO: 3079 - protein, 14 aa, synthetic construct
GHDSPHKIGQNQHA

SEQ ID NO: 3080 - protein, 14 aa, synthetic construct
GYDSPHKSGQKQQT

SEQ ID NO: 3081 - protein, 14 aa, synthetic construct
GHDSPHKSGQNQQT

SEQ ID NO: 3082 - protein, 14 aa, synthetic construct
GHDSPHKSGQSVQT

SEQ ID NO: 3083 - protein, 14 aa, synthetic construct
GHESPHKSGRSQQT

SEQ ID NO: 3084 - protein, 14 aa, synthetic construct
GHDSPHKSGQNKLE

SEQ ID NO: 3085 - protein, 14 aa, synthetic construct
GHDSPHKTGQNQQK

SEQ ID NO: 3086 - protein, 14 aa, synthetic construct
GRGSPHKRGQNQQT

SEQ ID NO: 3087 - protein, 14 aa, synthetic construct
GHDNPHKSGQNQQT

SEQ ID NO: 3088 - protein, 14 aa, synthetic construct
GQDSPHKSGQHQQA

SEQ ID NO: 3089 - protein, 14 aa, synthetic construct
GHDSPHKSGQIQHT

SEQ ID NO: 3090 - protein, 14 aa, synthetic construct
GHDSPHKSGPRQQT

SEQ ID NO: 3091 - protein, 14 aa, synthetic construct
GHDSPHKSGHTQQT

SEQ ID NO: 3092 - protein, 14 aa, synthetic construct
GHDSPHKSGQRQHT

SEQ ID NO: 3093 - protein, 14 aa, synthetic construct
GHDSPHKSAQSQQT

SEQ ID NO: 3094 - protein, 14 aa, synthetic construct
GHESPHKSGQNQQS

SEQ ID NO: 3095 - protein, 14 aa, synthetic construct
GHDSPHKSLQNQQT

SEQ ID NO: 3096 - protein, 14 aa, synthetic construct
GHDSPHKSGRNQET

SEQ ID NO: 3097 - protein, 14 aa, synthetic construct
GHDSPHKSGQTQLT

SEQ ID NO: 3098 - protein, 14 aa, synthetic construct
GHDSPHKSEKNQQT

SEQ ID NO: 3099 - protein, 14 aa, synthetic construct
GRDSPHKSGQDQQT

SEQ ID NO: 3100 - protein, 14 aa, synthetic construct
GHDSPHKTGHNQQT

SEQ ID NO: 3101 - protein, 14 aa, synthetic construct
AHDSPHKSGQNQLT

SEQ ID NO: 3102 - protein, 14 aa, synthetic construct
GYDSPHKSGQTQQT

SEQ ID NO: 3103 - protein, 14 aa, synthetic construct
GHESPHKSGQTQQI

SEQ ID NO: 3104 - protein, 14 aa, synthetic construct
GHDSPHKSGQSKQA

SEQ ID NO: 3105 - protein, 14 aa, synthetic construct
GHESPHKSGQNQQT

SEQ ID NO: 3106 - protein, 14 aa, synthetic construct
GHDSPHKTGQNQPP

SEQ ID NO: 3107 - protein, 14 aa, synthetic construct
GHDSPHKSGQSPQT

SEQ ID NO: 3108 - protein, 14 aa, synthetic construct
GNDSPHKSVQNQQT

SEQ ID NO: 3109 - protein, 14 aa, synthetic construct
GHDSPHKSAQNYQT

SEQ ID NO: 3110 - protein, 14 aa, synthetic construct
AHDSPHKIGQNHQT

SEQ ID NO: 3111 - protein, 14 aa, synthetic construct
GHESPHKSAQNRQT

SEQ ID NO: 3112 - protein, 14 aa, synthetic construct
GHDSPHKSGQNQQG

SEQ ID NO: 3113 - protein, 14 aa, synthetic construct
GQDSPHKIGQNQQT

SEQ ID NO: 3114 - protein, 14 aa, synthetic construct
GHDSPHKSGQNHLT

SEQ ID NO: 3115 - protein, 14 aa, synthetic construct
GHDSPHKSGQYQHT

SEQ ID NO: 3116 - protein, 14 aa, synthetic construct
GNDSPHKSVQNHQT

SEQ ID NO: 3117 - protein, 14 aa, synthetic construct
GHDSPHKSGQNQWT

SEQ ID NO: 3118 - protein, 14 aa, synthetic construct
GHDSPHKSVQNQHT

SEQ ID NO: 3119 - protein, 14 aa, synthetic construct
GHDSPHKSGQNQHA

SEQ ID NO: 3120 - protein, 14 aa, synthetic construct
GHDSPHKSGQTRQT

SEQ ID NO: 3121 - protein, 14 aa, synthetic construct
GHDSPHKSGQNLHT

SEQ ID NO: 3122 - protein, 14 aa, synthetic construct
GHDSPHKSGLNQQT

SEQ ID NO: 3123 - protein, 14 aa, synthetic construct
GHDSPHKSAQNQET

SEQ ID NO: 3124 - protein, 14 aa, synthetic construct
GHDSPHKSGQHLQT

SEQ ID NO: 3125 - protein, 14 aa, synthetic construct
GHDSPHKSRLNQPT

SEQ ID NO: 3126 - protein, 14 aa, synthetic construct
GHDSPHKSGQKQQT

SEQ ID NO: 3127 - protein, 14 aa, synthetic construct
GQDSPHKSGQNQDT

SEQ ID NO: 3128 - protein, 14 aa, synthetic construct
GHDSPHKSGRNQQT

SEQ ID NO: 3129 - protein, 14 aa, synthetic construct
GHDSPHKSGQNLLT

SEQ ID NO: 3130 - protein, 14 aa, synthetic construct
GHDSPHKSGQLVIT

SEQ ID NO: 3131 - protein, 14 aa, synthetic construct
GHDSPHKSRQSQQT

SEQ ID NO: 3132 - protein, 14 aa, synthetic construct
GHDSPHKSGRTQET

SEQ ID NO: 3133 - protein, 14 aa, synthetic construct
GHDSPHKSVQTHQT

SEQ ID NO: 3134 - protein, 14 aa, synthetic construct
GHDSPHKSGQNQPA

SEQ ID NO: 3135 - protein, 14 aa, synthetic construct
KHDSPHKSGQNQQT

SEQ ID NO: 3136 - protein, 14 aa, synthetic construct
GHDSPHKSGQTQQT

SEQ ID NO: 3137 - protein, 14 aa, synthetic construct
GPDSPHKIGQNQQS

SEQ ID NO: 3138 - protein, 14 aa, synthetic construct
GHDSPHKSVQNQQT

SEQ ID NO: 3139 - protein, 14 aa, synthetic construct
GHDSPHKSRQDQHT

SEQ ID NO: 3140 - protein, 14 aa, synthetic construct
GPDSPHKSGQKQQT

SEQ ID NO: 3141 - protein, 14 aa, synthetic construct
GHDSPHKSRQSQHT

SEQ ID NO: 3142 - protein, 14 aa, synthetic construct
GHDSPHKSVQNQLT

SEQ ID NO: 3143 - protein, 14 aa, synthetic construct
AHDSPHKSGQNQQT

SEQ ID NO: 3144 - protein, 14 aa, synthetic construct
GQDSPHKSGQNQQS

SEQ ID NO: 3145 - protein, 14 aa, synthetic construct
GHDSPHKSGRNQQI

SEQ ID NO: 3146 - protein, 14 aa, synthetic construct
GYDSPHKSGQYQHT

SEQ ID NO: 3147 - protein, 14 aa, synthetic construct
GHDSPHKSRQNQQT

SEQ ID NO: 3148 - protein, 14 aa, synthetic construct
GHDSPHKSWVRQQT

SEQ ID NO: 3149 - protein, 14 aa, synthetic construct
GHESPHKSGQNQHS

SEQ ID NO: 3150 - protein, 14 aa, synthetic construct
GHDSPHKIGHNQQT

SEQ ID NO: 3151 - protein, 14 aa, synthetic construct
WHDSPHKSGQNQQT

SEQ ID NO: 3152 - protein, 14 aa, synthetic construct
RHDSPHKSGQNQQT

SEQ ID NO: 3153 - protein, 14 aa, synthetic construct
GHDSPHKSNAWQQT

SEQ ID NO: 3154 - protein, 14 aa, synthetic construct
GHDSPHKSGQSVPT

SEQ ID NO: 3155 - protein, 14 aa, synthetic construct
GHESPHKSGQNIQP

SEQ ID NO: 3156 - protein, 14 aa, synthetic construct
GHDSPHKSVQNHLN

SEQ ID NO: 3157 - protein, 14 aa, synthetic construct
GHDSPHKIGLDQQT

SEQ ID NO: 3158 - protein, 14 aa, synthetic construct
GHDSPHKRGPDQQS

SEQ ID NO: 3159 - protein, 14 aa, synthetic construct
GHDSPHKSGESQQT

SEQ ID NO: 3160 - protein, 14 aa, synthetic construct
GHDSPHKHGQNHQT

SEQ ID NO: 3161 - protein, 14 aa, synthetic construct
LHDSPHKSGQNQQT

SEQ ID NO: 3162 - protein, 14 aa, synthetic construct
GHDSPHKSVQNKQT

SEQ ID NO: 3163 - protein, 14 aa, synthetic construct
GQVSPHKSGQNQQT

SEQ ID NO: 3164 - protein, 14 aa, synthetic construct
GHDSPHKSGQRQLT

SEQ ID NO: 3165 - protein, 14 aa, synthetic construct
GHDSPHKIGQNQLT

SEQ ID NO: 3166 - protein, 14 aa, synthetic construct
GHDSPHKSGQIIVT

SEQ ID NO: 3167 - protein, 14 aa, synthetic construct
IHDSPHKSGQNQQT

SEQ ID NO: 3168 - protein, 14 aa, synthetic construct
GYDSPHKSGQKQST

SEQ ID NO: 3169 - protein, 14 aa, synthetic construct
MHDSPHKSGQNQQT

SEQ ID NO: 3170 - protein, 14 aa, synthetic construct
GDDSPHKSVQNQQT

SEQ ID NO: 3171 - protein, 14 aa, synthetic construct
GHDSPHKSVQSHQT

SEQ ID NO: 3172 - protein, 14 aa, synthetic construct
GHDSPHKSGQFVVT

SEQ ID NO: 3173 - protein, 14 aa, synthetic construct
GHDSPHKSRQNLQT

SEQ ID NO: 3174 - protein, 14 aa, synthetic construct
GHNSPHKSGQNQET

SEQ ID NO: 3175 - protein, 14 aa, synthetic construct
GHDSPHKSAQNQQI

SEQ ID NO: 3176 - protein, 14 aa, synthetic construct
NHDSPHKSGQNQQT

SEQ ID NO: 3177 - protein, 14 aa, synthetic construct
GHDSPHKSGQSQPT

SEQ ID NO: 3178 - protein, 14 aa, synthetic construct
GHESPHKSGQNEQT

SEQ ID NO: 3179 - protein, 14 aa, synthetic construct
GHDSPHKSAQNQQT

SEQ ID NO: 3180 - protein, 14 aa, synthetic construct
GHDSPHKSGQNQLT

SEQ ID NO: 3181 - protein, 14 aa, synthetic construct
GHDSPHKSAQNLLT

SEQ ID NO: 3182 - protein, 14 aa, synthetic construct
THDSPHKSGQNQQT

SEQ ID NO: 3183 - protein, 14 aa, synthetic construct
GNGSPHKRGQNQQT

SEQ ID NO: 3184 - protein, 14 aa, synthetic construct
GHDSPHKSGQSLQT

SEQ ID NO: 3185 - protein, 14 aa, synthetic construct
GHDSPHKSAQNHQT

SEQ ID NO: 3186 - protein, 14 aa, synthetic construct
GHDSPHKSGRNRQT

SEQ ID NO: 3187 - protein, 14 aa, synthetic construct
EHDSPHKSGQNQQT

SEQ ID NO: 3188 - protein, 14 aa, synthetic construct
GHDSPHKYGQNEQT

SEQ ID NO: 3189 - protein, 14 aa, synthetic construct
RHDSPHKSGHNQQT

SEQ ID NO: 3190 - protein, 14 aa, synthetic construct
GHDSPHKSQQNQQT

SEQ ID NO: 3191 - protein, 14 aa, synthetic construct
GHDSPHKSGQNQQI

SEQ ID NO: 3192 - protein, 14 aa, synthetic construct
QHDSPHKSGQNQQT

SEQ ID NO: 3193 - protein, 14 aa, synthetic construct
RHDSPHKIVQNQQT

SEQ ID NO: 3194 - protein, 14 aa, synthetic construct
YHDSPHKSGQNQQT

SEQ ID NO: 3195 - protein, 14 aa, synthetic construct
GHDSPHKSVQSKQT

SEQ ID NO: 3196 - protein, 14 aa, synthetic construct
GNDSPHKIGHNQQT

SEQ ID NO: 3197 - protein, 14 aa, synthetic construct
HHDSPHKSGQNQQT

SEQ ID NO: 3198 - protein, 14 aa, synthetic construct
GHDSPHKSGQTQQI

SEQ ID NO: 3199 - protein, 14 aa, synthetic construct
GQDSPHKSGQNPLT

SEQ ID NO: 3200 - protein, 14 aa, synthetic construct
GHDSPHKSGRDQKT

SEQ ID NO: 3201 - protein, 14 aa, synthetic construct
GHDSPHKSVHNQQN

SEQ ID NO: 3202 - protein, 14 aa, synthetic construct
GHDSPHKSGQWKRT

SEQ ID NO: 3203 - protein, 14 aa, synthetic construct
GHDSPHKSGQSQQI

SEQ ID NO: 3204 - protein, 14 aa, synthetic construct
GHDSPHKSRQAQQT

SEQ ID NO: 3205 - protein, 14 aa, synthetic construct
GHDSPHKSVQNHQI

SEQ ID NO: 3206 - protein, 14 aa, synthetic construct
GHDSPHKSKQNQQA

SEQ ID NO: 3207 - protein, 14 aa, synthetic construct
GHDSPHKSAQNQLN

SEQ ID NO: 3208 - protein, 14 aa, synthetic construct
GHDSPHKSGQTQPT

SEQ ID NO: 3209 - protein, 14 aa, synthetic construct
FHDSPHKSGQNQQT

SEQ ID NO: 3210 - protein, 14 aa, synthetic construct
GHDSPHKLWINQQT

SEQ ID NO: 3211 - protein, 14 aa, synthetic construct
GPDSPHKSGQNQQT

SEQ ID NO: 3212 - protein, 14 aa, synthetic construct
GHDSPHKSVQKQLT

SEQ ID NO: 3213 - protein, 14 aa, synthetic construct
GHDSPHKSGRNQLA

SEQ ID NO: 3214 - protein, 14 aa, synthetic construct
VHDSPHKSGQNQQS

SEQ ID NO: 3215 - protein, 14 aa, synthetic construct
GHDSPHKMGRNQQS

SEQ ID NO: 3216 - protein, 14 aa, synthetic construct
GHDSPHKSGISIQT

SEQ ID NO: 3217 - protein, 14 aa, synthetic construct
VHDSPHKSGQNQQT

SEQ ID NO: 3218 - protein, 14 aa, synthetic construct
GHDSPHKSVQNLQT

SEQ ID NO: 3219 - protein, 14 aa, synthetic construct
GHDSPHKMAHNQQT

SEQ ID NO: 3220 - protein, 14 aa, synthetic construct
GHDSPHKHGQNQQN

SEQ ID NO: 3221 - protein, 14 aa, synthetic construct
GHDSPHKSVQSQQS

SEQ ID NO: 3222 - protein, 14 aa, synthetic construct
GHDSPHKSGQTVCT

SEQ ID NO: 3223 - protein, 14 aa, synthetic construct
GQDSPHKSGQYQQI

SEQ ID NO: 3224 - protein, 14 aa, synthetic construct
GHDSPHKSGQQIMT

SEQ ID NO: 3225 - protein, 14 aa, synthetic construct
GHDSPHKSRQNEQS

SEQ ID NO: 3226 - protein, 14 aa, synthetic construct
GHDSPHKSGLNHQT

SEQ ID NO: 3227 - protein, 14 aa, synthetic construct
GYDSPHKSGQNQQT

SEQ ID NO: 3228 - protein, 14 aa, synthetic construct
GHDSPHKSGQNLQT

SEQ ID NO: 3229 - protein, 14 aa, synthetic construct
GHDSPHKSRQDQQT

SEQ ID NO: 3230 - protein, 14 aa, synthetic construct
GDDSPHKSGQKQLT

SEQ ID NO: 3231 - protein, 14 aa, synthetic construct
GDDSPHKSGHNQQT

SEQ ID NO: 3232 - protein, 14 aa, synthetic construct
GHDSPHKSGQMIHT

SEQ ID NO: 3233 - protein, 14 aa, synthetic construct
GHDSPHKSGRNHQS

SEQ ID NO: 3234 - protein, 14 aa, synthetic construct
GHDSPHKSVQNRQT

SEQ ID NO: 3235 - protein, 14 aa, synthetic construct
GHDSPHKSGQKMNT

SEQ ID NO: 3236 - protein, 14 aa, synthetic construct
GHDSPHKSGQSQQN

SEQ ID NO: 3237 - protein, 14 aa, synthetic construct
GHDSPHKSGQYQHA

SEQ ID NO: 3238 - skipped

SEQ ID NO: 3239 - protein, 18 aa, synthetic construct
KTIIGSGSPHSKAQNRHT

SEQ ID NO: 3240 - protein, 18 aa, synthetic construct
KTFPGSGSPHSKVQNQQT

SEQ ID NO: 3241 - protein, 18 aa, synthetic construct
KTEKMSGSPHSKAQNQQT

SEQ ID NO: 3242 - protein, 18 aa, synthetic construct
KTVNGSGSPHSKARDQQT

SEQ ID NO: 3243 - protein, 18 aa, synthetic construct
KTFNGSGSPHSKAPNLQT

SEQ ID NO: 3244 - protein, 18 aa, synthetic construct
KTEKTSGSPHSKAQNQQT

SEQ ID NO: 3245 - protein, 18 aa, synthetic construct
KTINGSGSPHSKAHVRQT

SEQ ID NO: 3246 - protein, 18 aa, synthetic construct
KTVNGSGSPHSKAPNQHT

SEQ ID NO: 3247 - protein, 18 aa, synthetic construct
KTEKISGSPHSKAQNQQT

SEQ ID NO: 3248 - protein, 18 aa, synthetic construct
KTVNGSGSPHSKTQSQQT

SEQ ID NO: 3249 - protein, 18 aa, synthetic construct
TTINGSGSPHSKAQNQQT

SEQ ID NO: 3250 - protein, 18 aa, synthetic construct
KSINESGSPHSKAQNQQI

SEQ ID NO: 3251 - protein, 18 aa, synthetic construct
KTERTSGSPHSKAQNQQT

SEQ ID NO: 3252 - protein, 18 aa, synthetic construct
KTINGSGSPHSKAQPAKT

SEQ ID NO: 3253 - protein, 18 aa, synthetic construct
KTEKSSGSPHSKAQNQQT

SEQ ID NO: 3254 - protein, 18 aa, synthetic construct
KTEKGSGSPHSKAQNQQT

SEQ ID NO: 3255 - protein, 18 aa, synthetic construct
KTINGSGSPHSKSQTQQN

SEQ ID NO: 3256 - protein, 18 aa, synthetic construct
KTERISGSPHSKAQNQQT

SEQ ID NO: 3257 - protein, 18 aa, synthetic construct
KTERASGSPHSKAQNQQT

SEQ ID NO: 3258 - protein, 18 aa, synthetic construct
KELHGSGSPHSKAQNQQT

SEQ ID NO: 3259 - protein, 18 aa, synthetic construct
KAINGSGSPHSKAQNLAT

SEQ ID NO: 3260 - protein, 18 aa, synthetic construct
KTVNGSGSPHSKSQNQLT

SEQ ID NO: 3261 - protein, 18 aa, synthetic construct
KTERNSGSPHSKAQNQQT

SEQ ID NO: 3262 - protein, 18 aa, synthetic construct
KTFNGSGSPHSKAQGQQT

SEQ ID NO: 3263 - protein, 18 aa, synthetic construct
KTERVSGSPHSKAQNQQT

SEQ ID NO: 3264 - protein, 18 aa, synthetic construct
KTINGSGSPHSKALNRQS

SEQ ID NO: 3265 - protein, 18 aa, synthetic construct
KTERLSGSPHSKAQNQQT

SEQ ID NO: 3266 - protein, 18 aa, synthetic construct
KTDNGSGSPHSKAHNQQT

SEQ ID NO: 3267 - protein, 18 aa, synthetic construct
KTFHGSGSPHSKTQNQQT

SEQ ID NO: 3268 - protein, 18 aa, synthetic construct
KTSNGSGSPHSKAQNPPT

SEQ ID NO: 3269 - protein, 18 aa, synthetic construct
ETINGSGSPHSKAQNLQT

SEQ ID NO: 3270 - protein, 18 aa, synthetic construct
NTINGSGSPHSKAQNQQT

SEQ ID NO: 3271 - protein, 18 aa, synthetic construct
KTENMSGSPHSKAQNQQT

SEQ ID NO: 3272 - protein, 18 aa, synthetic construct
KTENVSGSPHSKAQNQQT

SEQ ID NO: 3273 - protein, 18 aa, synthetic construct
KTSSGSGSPHSKAQYQQT

SEQ ID NO: 3274 - protein, 18 aa, synthetic construct
KTEKVSGSPHSKAQNQQT

SEQ ID NO: 3275 - protein, 18 aa, synthetic construct
KAINGSGSPHSKAQDQET

SEQ ID NO: 3276 - protein, 18 aa, synthetic construct
KTCNKSGSPHSKAQNQQT

SEQ ID NO: 3277 - protein, 18 aa, synthetic construct
KTEHLSGSPHSKAQNQQT

SEQ ID NO: 3278 - protein, 18 aa, synthetic construct
KAEMGSGSPHSKAQNQQT

SEQ ID NO: 3279 - protein, 18 aa, synthetic construct
KATNGSGSPHSKAQNHQT

SEQ ID NO: 3280 - protein, 18 aa, synthetic construct
KAIKGSGSPHSKAQDQQT

SEQ ID NO: 3281 - protein, 18 aa, synthetic construct
KTINGSGSPHSKGHWQQT

SEQ ID NO: 3282 - protein, 18 aa, synthetic construct
KTDKTSGSPHSKAQNQQT

SEQ ID NO: 3283 - protein, 18 aa, synthetic construct
KTFKGSGSPHSKAPNQQT

SEQ ID NO: 3284 - protein, 18 aa, synthetic construct
KTVNGSGSPHSKAQNQLI

SEQ ID NO: 3285 - protein, 18 aa, synthetic construct
KTINGSGSPHSKRPEQQT

SEQ ID NO: 3286 - protein, 18 aa, synthetic construct
KTINGSGSPHSKAQRTMT

SEQ ID NO: 3287 - protein, 18 aa, synthetic construct
KTEKASGSPHSKAQNQQT

SEQ ID NO: 3288 - protein, 18 aa, synthetic construct
KSDQGSGSPHSKAQNQQT

SEQ ID NO: 3289 - protein, 18 aa, synthetic construct
KTEITSGSPHSKAQNQQT

SEQ ID NO: 3290 - protein, 18 aa, synthetic construct
KTDKSSGSPHSKAQNQQT

SEQ ID NO: 3291 - protein, 18 aa, synthetic construct
KTIDGSGSPHSKAQNQQH

SEQ ID NO: 3292 - protein, 18 aa, synthetic construct
KNTNGSGSPHSKAQNQQT

SEQ ID NO: 3293 - protein, 18 aa, synthetic construct
KTETHSGSPHSKAQNQQT

SEQ ID NO: 3294 - protein, 18 aa, synthetic construct
KTINGSGSPHSKALHQHT

SEQ ID NO: 3295 - protein, 18 aa, synthetic construct
KTINGSGSPHSKAQHRIT

SEQ ID NO: 3296 - protein, 18 aa, synthetic construct
KTINGSGSPHSKAQYIHT

SEQ ID NO: 3297 - protein, 18 aa, synthetic construct
KTENISGSPHSKAQNQQT

SEQ ID NO: 3298 - protein, 18 aa, synthetic construct
KTINGSGSPHSKAQKFET

SEQ ID NO: 3299 - protein, 18 aa, synthetic construct
KTSNESGSPHSKAQNHQT

SEQ ID NO: 3300 - protein, 18 aa, synthetic construct
KTINGSGSPHSKAQFPST

SEQ ID NO: 3301 - protein, 18 aa, synthetic construct
KTERPSGSPHSKAQNQQT

SEQ ID NO: 3302 - protein, 18 aa, synthetic construct
KTERMSGSPHSKAQNQQT

SEQ ID NO: 3303 - protein, 18 aa, synthetic construct
KTERSSGSPHSKAQNQQT

SEQ ID NO: 3304 - protein, 18 aa, synthetic construct
KTELHSGSPHSKAQNQQT

SEQ ID NO: 3305 - protein, 18 aa, synthetic construct
KTELTSGSPHSKAQNQQT

SEQ ID NO: 3306 - protein, 18 aa, synthetic construct
KTINGSGSPHSKAHNQQR

SEQ ID NO: 3307 - protein, 18 aa, synthetic construct
KTINGSGSPHSKAQAIKT

SEQ ID NO: 3308 - protein, 18 aa, synthetic construct
KTENTSGSPHSKAQNQQT

SEQ ID NO: 3309 - protein, 18 aa, synthetic construct
KTIDGSGSPHSKGQNRQT

SEQ ID NO: 3310 - protein, 18 aa, synthetic construct
KNINGSGSPHSKAQSQQT

SEQ ID NO: 3311 - protein, 18 aa, synthetic construct
KTSNASGSPHSKAQNQLT

SEQ ID NO: 3312 - protein, 18 aa, synthetic construct
KTEARSGSPHSKAQNQQT

SEQ ID NO: 3313 - protein, 18 aa, synthetic construct
KTEKNSGSPHSKAQNQQT

SEQ ID NO: 3314 - protein, 18 aa, synthetic construct
KTANGSGSPHSKAQYQQT

SEQ ID NO: 3315 - protein, 18 aa, synthetic construct
KTVNGSGSPHSKAQYQHT

SEQ ID NO: 3316 - protein, 18 aa, synthetic construct
KTINGSGSPHTKAQNPQS

SEQ ID NO: 3317 - protein, 18 aa, synthetic construct
KTINGSGSPHSKGQNPPT

SEQ ID NO: 3318 - protein, 18 aa, synthetic construct
KTIIGSGSPHSKAQHQLT

SEQ ID NO: 3319 - protein, 18 aa, synthetic construct
KTINGSGSPHSKAQSPPT

SEQ ID NO: 3320 - protein, 18 aa, synthetic construct
NTIYGSGSPHSKAQNQQT

SEQ ID NO: 3321 - protein, 18 aa, synthetic construct
KTINGSGSPHSKAQAKLT

SEQ ID NO: 3322 - protein, 18 aa, synthetic construct
KTDKNSGSPHSKAQNQQT

SEQ ID NO: 3323 - protein, 18 aa, synthetic construct
KTINGSGSPHSKTKSQQT

SEQ ID NO: 3324 - protein, 18 aa, synthetic construct
KTINGSGSPHSKAQDRPT

SEQ ID NO: 3325 - protein, 18 aa, synthetic construct
KTINGSGSPHSKAQSQQL

SEQ ID NO: 3326 - protein, 18 aa, synthetic construct
KTENLSGSPHSKAQNQQT

SEQ ID NO: 3327 - protein, 18 aa, synthetic construct
KTINGSGSPHSKAQAFHT

SEQ ID NO: 3328 - protein, 18 aa, synthetic construct
KTINGSGSPHSKAQKQQD

SEQ ID NO: 3329 - protein, 18 aa, synthetic construct
KTFSGSGSPHSKAQNLQT

SEQ ID NO: 3330 - protein, 18 aa, synthetic construct
KAINGSGSPHSKAQNAQT

SEQ ID NO: 3331 - protein, 18 aa, synthetic construct
KTESWSGSPHSKAQNQQT

SEQ ID NO: 3332 - protein, 18 aa, synthetic construct
KTTNGSGSPHSKAHNQLT

SEQ ID NO: 3333 - protein, 18 aa, synthetic construct
KTEDKSGSPHSKAQNQQT

SEQ ID NO: 3334 - protein, 18 aa, synthetic construct
KTESASGSPHSKAQNQQT

SEQ ID NO: 3335 - protein, 18 aa, synthetic construct
KTNNGSGSPHSKAQNQQY

SEQ ID NO: 3336 - protein, 18 aa, synthetic construct
KTDKMSGSPHSKAQNQQT

SEQ ID NO: 3337 - protein, 18 aa, synthetic construct
KEVHGSGSPHSKAQNQQT

SEQ ID NO: 3338 - protein, 18 aa, synthetic construct
KTINGSGSPHSKAQKLNT

SEQ ID NO: 3339 - protein, 18 aa, synthetic construct
KTTNGSGSPHSKAQYQHT

SEQ ID NO: 3340 - protein, 18 aa, synthetic construct
KTISGSGSPHSKAQYQHT

SEQ ID NO: 3341 - protein, 18 aa, synthetic construct
KTESTSGSPHSKAQNQQT

SEQ ID NO: 3342 - protein, 18 aa, synthetic construct
KTINGSGSPHSKSQNVQT

SEQ ID NO: 3343 - protein, 18 aa, synthetic construct
KSINGSGSPHSKAQAQQT

SEQ ID NO: 3344 - protein, 18 aa, synthetic construct
KTVNGSGSPHSKAQNLQA

SEQ ID NO: 3345 - protein, 18 aa, synthetic construct
KTVRDSGSPHSKAQNQQT

SEQ ID NO: 3346 - protein, 18 aa, synthetic construct
KTFNASGSPHSKAPNQQT

SEQ ID NO: 3347 - protein, 18 aa, synthetic construct
KTDRMSGSPHSKAQNQQT

SEQ ID NO: 3348 - protein, 18 aa, synthetic construct
KTINGSGSPHSKAQTPPT

SEQ ID NO: 3349 - protein, 18 aa, synthetic construct
ETIKGSGSPHSKAQNQQT

SEQ ID NO: 3350 - protein, 18 aa, synthetic construct
KNHIGSGSPHSKAQNQQT

SEQ ID NO: 3351 - protein, 18 aa, synthetic construct
KTINGSGSPHSKAQYQHA

SEQ ID NO: 3352 - protein, 18 aa, synthetic construct
KTINGSGSPHSKAQGQQA

SEQ ID NO: 3353 - protein, 18 aa, synthetic construct
KTFNGSGSPHNKAQNHQT

SEQ ID NO: 3354 - protein, 18 aa, synthetic construct
KESDGSGSPHSKAQNQQT

SEQ ID NO: 3355 - protein, 18 aa, synthetic construct
KTINGSGSPHSKAQPPAT

SEQ ID NO: 3356 - protein, 18 aa, synthetic construct
KTINGSGSPHSKAQERPT

SEQ ID NO: 3357 - protein, 18 aa, synthetic construct
KTIKGSGSPHSKAQDLQT

SEQ ID NO: 3358 - protein, 18 aa, synthetic construct
KTDLKSGSPHSKAQNQQT

SEQ ID NO: 3359 - protein, 18 aa, synthetic construct
KTINGSGSPHSKAQAMHT

SEQ ID NO: 3360 - protein, 18 aa, synthetic construct
KTVPNSGSPHSKAQNQQT

SEQ ID NO: 3361 - protein, 18 aa, synthetic construct
KTVIGSGSPHSKALNQQT

SEQ ID NO: 3362 - protein, 18 aa, synthetic construct
KTINGSGSPHSKAQHPST

SEQ ID NO: 3363 - protein, 18 aa, synthetic construct
KTINGSGSPHSKAPGLQT

SEQ ID NO: 3364 - protein, 18 aa, synthetic construct
KTINGSGSPHSKAQGIRT

SEQ ID NO: 3365 - protein, 18 aa, synthetic construct
KTESHSGSPHSKAQNQQT

SEQ ID NO: 3366 - protein, 18 aa, synthetic construct
KTINGSGSPHSKAQAPAT

SEQ ID NO: 3367 - protein, 18 aa, synthetic construct
KTINGSGSPHSKSQSQQI

SEQ ID NO: 3368 - protein, 18 aa, synthetic construct
KAEHGSGSPHSKAQNQQT

SEQ ID NO: 3369 - protein, 18 aa, synthetic construct
KTEDRSGSPHSKAQNQQT

SEQ ID NO: 3370 - protein, 18 aa, synthetic construct
KNCLGSGSPHSKAQNQQT

SEQ ID NO: 3371 - protein, 18 aa, synthetic construct
KTDRGSGSPHSKAQNQQT

SEQ ID NO: 3372 - protein, 18 aa, synthetic construct
KTINGSGSPHSKAQIPPT

SEQ ID NO: 3373 - protein, 18 aa, synthetic construct
KTVKGSGSPHSKAQDQQT

SEQ ID NO: 3374 - protein, 18 aa, synthetic construct
KNADGSGSPHSKAQNQQT

SEQ ID NO: 3375 - protein, 18 aa, synthetic construct
KTDKVSGSPHSKAQNQQT

SEQ ID NO: 3376 - protein, 18 aa, synthetic construct
KTITGSGSPHSKAQTQLT

SEQ ID NO: 3377 - protein, 18 aa, synthetic construct
KTINGSGSPHSKAQAPST

SEQ ID NO: 3378 - protein, 18 aa, synthetic construct
KNCVGSGSPHSKAQNQQT

SEQ ID NO: 3379 - protein, 18 aa, synthetic construct
KTVKDSGSPHSKAQNQQT

SEQ ID NO: 3380 - protein, 18 aa, synthetic construct
KNALGSGSPHSKAQNQQT

SEQ ID NO: 3381 - protein, 18 aa, synthetic construct
KVINGSGSPHSKGQNQQT

SEQ ID NO: 3382 - protein, 18 aa, synthetic construct
KTSNASGSPHSKAHNQQT

SEQ ID NO: 3383 - protein, 18 aa, synthetic construct
KTINGSGSPHSKAQNTYA

SEQ ID NO: 3384 - protein, 18 aa, synthetic construct
KTINGSGSPHSKSQNQHI

SEQ ID NO: 3385 - protein, 18 aa, synthetic construct
KTEFVSGSPHSKAQNQQT

SEQ ID NO: 3386 - protein, 18 aa, synthetic construct
KTVNGSGSPHSKAQNHLT

SEQ ID NO: 3387 - protein, 18 aa, synthetic construct
KTREISGSPHSKAQNQQT

SEQ ID NO: 3388 - protein, 18 aa, synthetic construct
KTINGSGSPHSKAQIGMT

SEQ ID NO: 3389 - protein, 18 aa, synthetic construct
KTIDGSGSPHSKALNKQT

SEQ ID NO: 3390 - protein, 18 aa, synthetic construct
KQGEGSGSPHSKAQNQQT

SEQ ID NO: 3391 - protein, 18 aa, synthetic construct
KTVNGSGSPHSKAQLQQT

SEQ ID NO: 3392 - protein, 18 aa, synthetic construct
KSINGSGSPHSKTQSQQT

SEQ ID NO: 3393 - protein, 18 aa, synthetic construct
KSEKGSGSPHSKAQNQQT

SEQ ID NO: 3394 - protein, 18 aa, synthetic construct
KNVNGSGSPHSKAQNQQT

SEQ ID NO: 3395 - protein, 18 aa, synthetic construct
KGGEGSGSPHSKAQNQQT

SEQ ID NO: 3396 - protein, 18 aa, synthetic construct
KTINGSGSPHSKAQRMST

SEQ ID NO: 3397 - protein, 18 aa, synthetic construct
KTINGSGSPHSKAQGILT

SEQ ID NO: 3398 - protein, 18 aa, synthetic construct
KEFVGSGSPHSKAQNQQT

SEQ ID NO: 3399 - protein, 18 aa, synthetic construct
KTIIGSGSPHSKAQDRQT

SEQ ID NO: 3400 - protein, 18 aa, synthetic construct
KSDKGSGSPHSKAQNQQT

SEQ ID NO: 3401 - protein, 18 aa, synthetic construct
KTEQVSGSPHSKAQNQQT

SEQ ID NO: 3402 - protein, 18 aa, synthetic construct
KTEHVSGSPHSKAQNQQT

SEQ ID NO: 3403 - protein, 18 aa, synthetic construct
KTINGSGSPHSKARDWQT

SEQ ID NO: 3404 - protein, 18 aa, synthetic construct
KTENASGSPHSKAQNQQT

SEQ ID NO: 3405 - protein, 18 aa, synthetic construct
KEVQGSGSPHSKAQNQQT

SEQ ID NO: 3406 - protein, 18 aa, synthetic construct
KTINGSGSPHSKAQNTHD

SEQ ID NO: 3407 - protein, 18 aa, synthetic construct
KTINGSGSPHSKAPNLQI

SEQ ID NO: 3408 - protein, 18 aa, synthetic construct
KTINGSGSPHSKAQERST

SEQ ID NO: 3409 - protein, 18 aa, synthetic construct
KTSNGSGSPHSKAQNYQT

SEQ ID NO: 3410 - protein, 18 aa, synthetic construct
KTEYISGSPHSKAQNQQT

SEQ ID NO: 3411 - protein, 18 aa, synthetic construct
KTINGSGSPHSKAQRTCT

SEQ ID NO: 3412 - protein, 18 aa, synthetic construct
KTINGSGSPHSKAQIGHT

SEQ ID NO: 3413 - protein, 18 aa, synthetic construct
KNCWGSGSPHSKAQNQQT

SEQ ID NO: 3414 - protein, 18 aa, synthetic construct
KTINGSGSPHSKAQGAIT

SEQ ID NO: 3415 - protein, 18 aa, synthetic construct
KTDVNSGSPHSKAQNQQT

SEQ ID NO: 3416 - protein, 18 aa, synthetic construct
KSDIGSGSPHSKAQNQQT

SEQ ID NO: 3417 - protein, 18 aa, synthetic construct
KTINGSGSPHSKAQVPPT

SEQ ID NO: 3418 - protein, 18 aa, synthetic construct
KTINGSGSPHSKAQVQQI

SEQ ID NO: 3419 - protein, 18 aa, synthetic construct
KTINGSGSPHSKALMRQT

SEQ ID NO: 3420 - protein, 18 aa, synthetic construct
KTINGSGSPHSKAQYSVT

SEQ ID NO: 3421 - protein, 18 aa, synthetic construct
KNSIGSGSPHSKAQNQQT

SEQ ID NO: 3422 - protein, 18 aa, synthetic construct
KTINGSGSPHSKVPNLQT

SEQ ID NO: 3423 - protein, 18 aa, synthetic construct
KAINGSGSPHSKAQSQQI

SEQ ID NO: 3424 - protein, 18 aa, synthetic construct
KTINGSGSPHSKAQAITT

SEQ ID NO: 3425 - protein, 18 aa, synthetic construct
KTINGSGSPHSKAQKTLT

SEQ ID NO: 3426 - protein, 18 aa, synthetic construct
KTVNGSGSPHSKAQNQWT

SEQ ID NO: 3427 - protein, 18 aa, synthetic construct
KTINGSGSPHSKAQLHHT

SEQ ID NO: 3428 - protein, 18 aa, synthetic construct
KTEQTSGSPHSKAQNQQT

SEQ ID NO: 3429 - protein, 18 aa, synthetic construct
KTINGSGSPHSKAQNIII

SEQ ID NO: 3430 - protein, 18 aa, synthetic construct
KNSLGSGSPHSKAQNQQT

SEQ ID NO: 3431 - protein, 18 aa, synthetic construct
KTINGSGSPHSKAQGHHT

SEQ ID NO: 3432 - protein, 18 aa, synthetic construct
KTDRTSGSPHSKAQNQQT

SEQ ID NO: 3433 - protein, 18 aa, synthetic construct
KTINGSGSPHSKAQSKVT

SEQ ID NO: 3434 - protein, 18 aa, synthetic construct
KEVVGSGSPHSKAQNQQT

SEQ ID NO: 3435 - protein, 18 aa, synthetic construct
KTINGSGSPHSKAQLPST

SEQ ID NO: 3436 - protein, 18 aa, synthetic construct
KTINGSGSPHSKAIGKQT

SEQ ID NO: 3437 - protein, 18 aa, synthetic construct
KTEPTSGSPHSKAQNQQT

SEQ ID NO: 3438 - protein, 18 aa, synthetic construct
KTINGSGSPHSKAQAIHT

SEQ ID NO: 3439 - protein, 18 aa, synthetic construct
KTINGSGSPHSKAQHGLT

SEQ ID NO: 3440 - protein, 18 aa, synthetic construct
KSELGSGSPHSKAQNQQT

SEQ ID NO: 3441 - protein, 18 aa, synthetic construct
KTINGSGSPHSKAQFMCT

SEQ ID NO: 3442 - protein, 18 aa, synthetic construct
KTINVSGSPHSKAQGQQT

SEQ ID NO: 3443 - protein, 18 aa, synthetic construct
KTVNGSGSPHSKAQHLQT

SEQ ID NO: 3444 - protein, 18 aa, synthetic construct
KTINGSGSPHSKTQNHQN

SEQ ID NO: 3445 - protein, 18 aa, synthetic construct
KTINGSGSPHSKAQPART

SEQ ID NO: 3446 - protein, 18 aa, synthetic construct
KTVNGSGSPHSKAQSLQT

SEQ ID NO: 3447 - protein, 18 aa, synthetic construct
KTINGSGSPHSKSQSQLT

SEQ ID NO: 3448 - protein, 18 aa, synthetic construct
KTWQNSGSPHSKAQNQQT

SEQ ID NO: 3449 - protein, 18 aa, synthetic construct
KTINGSGSPHSKAQDRQS

SEQ ID NO: 3450 - protein, 18 aa, synthetic construct
KTINGSGSPHSKAQMPST

SEQ ID NO: 3451 - protein, 18 aa, synthetic construct
KTINGSGSPHSKAQGSLT

SEQ ID NO: 3452 - protein, 18 aa, synthetic construct
KTEVTSGSPHSKAQNQQT

SEQ ID NO: 3453 - protein, 18 aa, synthetic construct
KTVIGSGSPHSKSQNQQT

SEQ ID NO: 3454 - protein, 18 aa, synthetic construct
KAVNVSGSPHSKAQNQQT

SEQ ID NO: 3455 - protein, 18 aa, synthetic construct
KTDRNSGSPHSKAQNQQT

SEQ ID NO: 3456 - protein, 18 aa, synthetic construct
KTINGSGSPHSKAQVPAT

SEQ ID NO: 3457 - protein, 18 aa, synthetic construct
KGVLGSGSPHSKAQNQQT

SEQ ID NO: 3458 - protein, 18 aa, synthetic construct
KAINGSGSPHSKAQDKQT

SEQ ID NO: 3459 - protein, 18 aa, synthetic construct
KTSNGSGSPHSKAHYQQT

SEQ ID NO: 3460 - protein, 18 aa, synthetic construct
KTINGSGSPHSKAQVPST

SEQ ID NO: 3461 - protein, 18 aa, synthetic construct
KTELRSGSPHSKAQNQQT

SEQ ID NO: 3462 - protein, 18 aa, synthetic construct
KNINGSGSPHSKAQNHQT

SEQ ID NO: 3463 - protein, 18 aa, synthetic construct
KTINGSGSPHSKARGEQT

SEQ ID NO: 3464 - protein, 18 aa, synthetic construct
KTEDLSGSPHSKAQNQQT

SEQ ID NO: 3465 - protein, 18 aa, synthetic construct
KTINGSGSPHSKAPGQQT

SEQ ID NO: 3466 - protein, 18 aa, synthetic construct
KTINGSGSPHSKAQSLQI

SEQ ID NO: 3467 - protein, 18 aa, synthetic construct
KTINGSGSPHSKRLEQQT

SEQ ID NO: 3468 - protein, 18 aa, synthetic construct
KTERGSGSPHSKAQNQQT

SEQ ID NO: 3469 - protein, 18 aa, synthetic construct
KTVNGSGSPHSKAPNQQT

SEQ ID NO: 3470 - protein, 18 aa, synthetic construct
KTSNGSGSPHSKAQNQST

SEQ ID NO: 3471 - protein, 18 aa, synthetic construct
KTINGSGSPHSKAQKVIT

SEQ ID NO: 3472 - protein, 18 aa, synthetic construct
KTEGISGSPHSKAQNQQT

SEQ ID NO: 3473 - protein, 18 aa, synthetic construct
KTINGSGSPHSKAQNNDQ

SEQ ID NO: 3474 - protein, 18 aa, synthetic construct
KTINGSGSPHSKAQSVHT

SEQ ID NO: 3475 - protein, 18 aa, synthetic construct
KTINGSGSPHSKAQPLGT

SEQ ID NO: 3476 - protein, 18 aa, synthetic construct
KTCNASGSPHSKAQNQQT

SEQ ID NO: 3477 - protein, 18 aa, synthetic construct
KAINGSGSPHSKAHNQET

SEQ ID NO: 3478 - protein, 18 aa, synthetic construct
KTEGLSGSPHSKAQNQQT

SEQ ID NO: 3479 - protein, 18 aa, synthetic construct
KTRDASGSPHSKAQNQQT

SEQ ID NO: 3480 - protein, 18 aa, synthetic construct
KTSNGSGSPHSKAQNLQI

SEQ ID NO: 3481 - protein, 18 aa, synthetic construct
KTGNGSGSPHSKAQIQQT

SEQ ID NO: 3482 - protein, 18 aa, synthetic construct
KTDRSSGSPHSKAQNQQT

SEQ ID NO: 3483 - protein, 18 aa, synthetic construct
KTINGSGSPHSKAQVRNT

SEQ ID NO: 3484 - protein, 18 aa, synthetic construct
KTINGSGSPHSKAPSNQT

SEQ ID NO: 3485 - protein, 18 aa, synthetic construct
KTINGSGSPHSKAQVGHT

SEQ ID NO: 3486 - protein, 18 aa, synthetic construct
KNAIGSGSPHSKAQNQQT

SEQ ID NO: 3487 - protein, 18 aa, synthetic construct
KAENGSGSPHSKAQNQQT

SEQ ID NO: 3488 - protein, 18 aa, synthetic construct
KTINGSGSPHSKAQRDIT

SEQ ID NO: 3489 - protein, 18 aa, synthetic construct
KTINGSGSPHSKAQMPNT

SEQ ID NO: 3490 - protein, 18 aa, synthetic construct
KTVNGSGSPHSKSQNQQT

SEQ ID NO: 3491 - protein, 18 aa, synthetic construct
KTINGSGSPHSKARGLQT

SEQ ID NO: 3492 - protein, 18 aa, synthetic construct
KTELGSGSPHSKAQNQQT

SEQ ID NO: 3493 - protein, 18 aa, synthetic construct
KAETGSGSPHSKAQNQQT

SEQ ID NO: 3494 - protein, 18 aa, synthetic construct
KTINGSGSPHSKLQKQQT

SEQ ID NO: 3495 - protein, 18 aa, synthetic construct
KTINGSGSPHSKAPSLQT

SEQ ID NO: 3496 - protein, 18 aa, synthetic construct
KTINGSGSPHSKAQRDQT

SEQ ID NO: 3497 - protein, 18 aa, synthetic construct
KTDVGSGSPHSKAQNQQT

SEQ ID NO: 3498 - protein, 18 aa, synthetic construct
KTINGSGSPHSKNRDQQT

SEQ ID NO: 3499 - protein, 18 aa, synthetic construct
KSINGSGSPHSKAPNLQT

SEQ ID NO: 3500 - protein, 18 aa, synthetic construct
KTINGSGSPHSKAQAKGT

SEQ ID NO: 3501 - protein, 18 aa, synthetic construct
KTVNGSGSPHSKAQDKQT

SEQ ID NO: 3502 - protein, 18 aa, synthetic construct
KTINGSGSPHSKAQSAHT

SEQ ID NO: 3503 - protein, 18 aa, synthetic construct
KTVPTSGSPHSKAQNQQT

SEQ ID NO: 3504 - protein, 18 aa, synthetic construct
KTIDGSGSPHSKSQNHQT

SEQ ID NO: 3505 - protein, 18 aa, synthetic construct
KTDVKSGSPHSKAQNQQT

SEQ ID NO: 3506 - protein, 18 aa, synthetic construct
KAINRSGSPHSKAQDQQT

SEQ ID NO: 3507 - protein, 18 aa, synthetic construct
KTINGSGSPHSKAQSTMT

SEQ ID NO: 3508 - protein, 18 aa, synthetic construct
KTVNASGSPHSKAQNQLT

SEQ ID NO: 3509 - protein, 18 aa, synthetic construct
KTINGSGSPHSKAQREMT

SEQ ID NO: 3510 - protein, 18 aa, synthetic construct
KTVHGSGSPHSKAQSQQT

SEQ ID NO: 3511 - protein, 18 aa, synthetic construct
KTINGSGSPHSKAQYRAT

SEQ ID NO: 3512 - protein, 18 aa, synthetic construct
KTEPMSGSPHSKAQNQQT

SEQ ID NO: 3513 - protein, 18 aa, synthetic construct
KTINGSGSPHSKNQWQQT

SEQ ID NO: 3514 - protein, 18 aa, synthetic construct
KETAGSGSPHSKAQNQQT

SEQ ID NO: 3515 - protein, 18 aa, synthetic construct
KTINGSGSPHSKAQRMNT

SEQ ID NO: 3516 - protein, 18 aa, synthetic construct
KNNLGSGSPHSKAQNQQT

SEQ ID NO: 3517 - protein, 18 aa, synthetic construct
KTINGSGSPHAKAQNHQT

SEQ ID NO: 3518 - protein, 18 aa, synthetic construct
KTINGSGSPHSKAGDSQT

SEQ ID NO: 3519 - protein, 18 aa, synthetic construct
KTINGSGSPHSKLKSQQT

SEQ ID NO: 3520 - protein, 18 aa, synthetic construct
KTINGSGSPHSKAQKIST

SEQ ID NO: 3521 - protein, 18 aa, synthetic construct
KTEYNSGSPHSKAQNQQT

SEQ ID NO: 3522 - protein, 18 aa, synthetic construct
KTINGSGSPHSKAPSMQT

SEQ ID NO: 3523 - protein, 18 aa, synthetic construct
EAINGSGSPHSKAQNQQT

SEQ ID NO: 3524 - protein, 18 aa, synthetic construct
KTINGSGSPHSKASPRQT

SEQ ID NO: 3525 - protein, 18 aa, synthetic construct
KTINGSGSPHSKRMEQQT

SEQ ID NO: 3526 - protein, 18 aa, synthetic construct
KTINGSGSPHSKAQYQNT

SEQ ID NO: 3527 - protein, 18 aa, synthetic construct
KEINGRGSPHSKAQNQQT

SEQ ID NO: 3528 - protein, 18 aa, synthetic construct
KTVNRNGSPHSKAQNQQT

SEQ ID NO: 3529 - protein, 18 aa, synthetic construct
KTINGPGSPHSKAHNQQT

SEQ ID NO: 3530 - protein, 18 aa, synthetic construct
KTSYGNGSPHSKAQNQQT

SEQ ID NO: 3531 - protein, 18 aa, synthetic construct
KSVNGNGSPHSKAQNQQT

SEQ ID NO: 3532 - protein, 18 aa, synthetic construct
KTINGSGSPHGWVQNQQT

SEQ ID NO: 3533 - protein, 18 aa, synthetic construct
KTINGGGSPHSKAQTQQI

SEQ ID NO: 3534 - protein, 18 aa, synthetic construct
KTVHGNGSPHSKAQNQQT

SEQ ID NO: 3535 - protein, 18 aa, synthetic construct
KTINGGGSPHSKAQNQQC

SEQ ID NO: 3536 - protein, 18 aa, synthetic construct
KTIDGGGSPHSKAQNKQT

SEQ ID NO: 3537 - protein, 18 aa, synthetic construct
KTINGGGSPHSKAQNQLI

SEQ ID NO: 3538 - protein, 18 aa, synthetic construct
KNINGGGSPHSKAQNQQT

SEQ ID NO: 3539 - protein, 18 aa, synthetic construct
KTINGGGSPHSKSQNQLT

SEQ ID NO: 3540 - protein, 18 aa, synthetic construct
KTVNGNGSPHSKAQNKQT

SEQ ID NO: 3541 - protein, 18 aa, synthetic construct
KTVNGNGSPHSKAQNQHT

SEQ ID NO: 3542 - protein, 18 aa, synthetic construct
KTINGGGSPHSKALNQQN

SEQ ID NO: 3543 - protein, 18 aa, synthetic construct
KTINGTGSPHSKAQNHQI

SEQ ID NO: 3544 - protein, 18 aa, synthetic construct
KTIIGGGSPHSKAHNQQT

SEQ ID NO: 3545 - protein, 18 aa, synthetic construct
KTINGNGSPHSKAQNPLT

SEQ ID NO: 3546 - protein, 18 aa, synthetic construct
KSIKGNGSPHSKAQNQQT

SEQ ID NO: 3547 - protein, 18 aa, synthetic construct
KTINGGGSPHSKAQSQQI

SEQ ID NO: 3548 - protein, 18 aa, synthetic construct
KTINGSVSPHGKAQNQLT

SEQ ID NO: 3549 - protein, 18 aa, synthetic construct
KTINGIGSPHSKAQNLGT

SEQ ID NO: 3550 - protein, 18 aa, synthetic construct
KTVNGNGSPHSKAQNHQT

SEQ ID NO: 3551 - protein, 18 aa, synthetic construct
KTSNGGGSPHSKAQNLQT

SEQ ID NO: 3552 - protein, 18 aa, synthetic construct
KTINGGGSPHSKSQNQHT

SEQ ID NO: 3553 - protein, 18 aa, synthetic construct
KTVNGGGSPHSKAQSQQT

SEQ ID NO: 3554 - protein, 18 aa, synthetic construct
KTIPIDGSPHSKAQNQQT

SEQ ID NO: 3555 - protein, 18 aa, synthetic construct
KTINGGGSPHSKAQNPPT

SEQ ID NO: 3556 - protein, 18 aa, synthetic construct
KTINGLGSPHSKSQNQQT

SEQ ID NO: 3557 - protein, 18 aa, synthetic construct
KTINGTGSPHSKAQNQQM

SEQ ID NO: 3558 - protein, 18 aa, synthetic construct
KTIRDAGSPHSKAQNQQT

SEQ ID NO: 3559 - protein, 18 aa, synthetic construct
KTVNGGGSPHSKAQNQQS

SEQ ID NO: 3560 - protein, 18 aa, synthetic construct
KTIQDGGSPHSKAQNQQT

SEQ ID NO: 3561 - protein, 18 aa, synthetic construct
KTISGGGSPHSKAQNQQN

SEQ ID NO: 3562 - protein, 18 aa, synthetic construct
KTINGGGSPHSKAQDKQT

SEQ ID NO: 3563 - protein, 18 aa, synthetic construct
KTIIGGGSPHSKAQNPQT

SEQ ID NO: 3564 - protein, 18 aa, synthetic construct
KTINGTGSPHSKAPNQLT

SEQ ID NO: 3565 - protein, 18 aa, synthetic construct
KTFNGGGSPHSKAQYQQT

SEQ ID NO: 3566 - protein, 18 aa, synthetic construct
KTVNGGGSPHSKAQHQQT

SEQ ID NO: 3567 - protein, 18 aa, synthetic construct
KTIPMEGSPHSKAQNQQT

SEQ ID NO: 3568 - protein, 18 aa, synthetic construct
KTVNGGGSPHSKSQNQQT

SEQ ID NO: 3569 - protein, 18 aa, synthetic construct
KTINGGGSPHSKAQNQMT

SEQ ID NO: 3570 - protein, 18 aa, synthetic construct
KTIRENGSPHSKAQNQQT

SEQ ID NO: 3571 - protein, 18 aa, synthetic construct
KTINGSASPHSKAHSQQT

SEQ ID NO: 3572 - protein, 18 aa, synthetic construct
KTNNGGGSPHSKAQNLQT

SEQ ID NO: 3573 - protein, 18 aa, synthetic construct
KSINGGGSPHSKAQYQQT

SEQ ID NO: 3574 - protein, 18 aa, synthetic construct
KTVNGNGSPHSKSQNQQT

SEQ ID NO: 3575 - protein, 18 aa, synthetic construct
KTLNGNGSPHSKAQNLQT

SEQ ID NO: 3576 - protein, 18 aa, synthetic construct
KTINGSGSSHSKAQNQQT

SEQ ID NO: 3577 - protein, 18 aa, synthetic construct
KTVNGGGSPHSKAQNHQT

SEQ ID NO: 3578 - protein, 18 aa, synthetic construct
KTINGGGSPHSKAQYQHT

SEQ ID NO: 3579 - protein, 18 aa, synthetic construct
KTIPKNGSPHSKAQNQQT

SEQ ID NO: 3580 - protein, 18 aa, synthetic construct
KTINKEGSPHSKAQNQQT

SEQ ID NO: 3581 - protein, 18 aa, synthetic construct
KTVNGGGSPHSKAQNLQT

SEQ ID NO: 3582 - protein, 18 aa, synthetic construct
KTIPAIGSPHSKAQNQQT

SEQ ID NO: 3583 - protein, 18 aa, synthetic construct
KTINGGGSPHSKAQNPQA

SEQ ID NO: 3584 - protein, 18 aa, synthetic construct
KTINGNGSPHSKSQNQHT

SEQ ID NO: 3585 - protein, 18 aa, synthetic construct
KTINGGGSPHSKSQNRQT

SEQ ID NO: 3586 - protein, 18 aa, synthetic construct
KTINGGGSPHSKAQRQQT

SEQ ID NO: 3587 - protein, 18 aa, synthetic construct
KTIIKNGSPHSKAQNQQT

SEQ ID NO: 3588 - protein, 18 aa, synthetic construct
KTINGSGSPHSYHVNQQT

SEQ ID NO: 3589 - protein, 18 aa, synthetic construct
KTERVSGSPHSKAQNQQT

SEQ ID NO: 3590 - skipped

SEQ ID NO: 3591 - protein, 18 aa, synthetic construct
KTFNRSGSPHSKAQNQQI

SEQ ID NO: 3592 - protein, 18 aa, synthetic construct
KTINGSGSPHTKAQNPPT

SEQ ID NO: 3593 - protein, 18 aa, synthetic construct
KSLNGSGSPHTKAQNQQT

SEQ ID NO: 3594 - protein, 18 aa, synthetic construct
KTENKSGSPHSKAQNQQT

SEQ ID NO: 3595 - protein, 18 aa, synthetic construct
KTDKGSGSPHSKAQNQQT

SEQ ID NO: 3596 - protein, 18 aa, synthetic construct
KTSNASGSPHSKAQHQQT

SEQ ID NO: 3597 - protein, 18 aa, synthetic construct
KTINASGSPHSKAINQQT

SEQ ID NO: 3598 - protein, 18 aa, synthetic construct
KTINGSGSPHSKAPNQQH

SEQ ID NO: 3599 - protein, 18 aa, synthetic construct
KTVNASGSPHSKAQNHQT

SEQ ID NO: 3600 - protein, 18 aa, synthetic construct
KTIDGSGSPHSKAENRQT

SEQ ID NO: 3601 - protein, 18 aa, synthetic construct
KTIKGSGSPHSKVQDQQT

SEQ ID NO: 3602 - protein, 18 aa, synthetic construct
KAINGSGSPHSKAQTQQA

SEQ ID NO: 3603 - protein, 18 aa, synthetic construct
KTEAKSGSPHSKAQNQQT

SEQ ID NO: 3604 - protein, 18 aa, synthetic construct
KTIPGSGSPHSKAQNLQT

SEQ ID NO: 3605 - protein, 18 aa, synthetic construct
KTIHGSGSPHSKAQNQAT

SEQ ID NO: 3606 - protein, 18 aa, synthetic construct
KAINGHDSPHKSGQIRQT

SEQ ID NO: 3607 - protein, 18 aa, synthetic construct
KTINGHDSPHKIGQNQHA

SEQ ID NO: 3608 - protein, 18 aa, synthetic construct
KAINGYDSPHKSGQKQQT

SEQ ID NO: 3609 - protein, 18 aa, synthetic construct
KTESGHDSPHKSGQNQQT

SEQ ID NO: 3610 - protein, 18 aa, synthetic construct
KTINGHDSPHKSGQSVQT

SEQ ID NO: 3611 - protein, 18 aa, synthetic construct
TTINGHDSPHKSGQNQQT

SEQ ID NO: 3612 - protein, 18 aa, synthetic construct
KTINGHESPHKSGRSQQT

SEQ ID NO: 3613 - protein, 18 aa, synthetic construct
KTINGHDSPHKSGQNKLE

SEQ ID NO: 3614 - protein, 18 aa, synthetic construct
KTINGHDSPHKTGQNQQK

SEQ ID NO: 3615 - protein, 18 aa, synthetic construct
KAINGHDNPHKSGQNQQT

SEQ ID NO: 3616 - protein, 18 aa, synthetic construct
KTINGQDSPHKSGQHQQA

SEQ ID NO: 3617 - protein, 18 aa, synthetic construct
KSINGHDSPHKSGQIQHT

SEQ ID NO: 3618 - protein, 18 aa, synthetic construct
KAINGHDSPHKSGPRQQT

SEQ ID NO: 3619 - protein, 18 aa, synthetic construct
KTVNGHDSPHKSGHTQQT

SEQ ID NO: 3620 - protein, 18 aa, synthetic construct
KSINGHDSPHKSGQRQHT

SEQ ID NO: 3621 - protein, 18 aa, synthetic construct
KAINGHDSPHKSAQSQQT

SEQ ID NO: 3622 - protein, 18 aa, synthetic construct
KSIYGHESPHKSGQNQQS

SEQ ID NO: 3623 - protein, 18 aa, synthetic construct
KTVNGHDSPHKSLQNQQT

SEQ ID NO: 3624 - protein, 18 aa, synthetic construct
KTSNGYDSPHKSGQKQQT

SEQ ID NO: 3625 - protein, 18 aa, synthetic construct
KTVNGHDSPHKSGRNQET

SEQ ID NO: 3626 - protein, 18 aa, synthetic construct
KTTNGHDSPHKSGQTQLT

SEQ ID NO: 3627 - protein, 18 aa, synthetic construct
KAINGHDSPHKSEKNQQT

SEQ ID NO: 3628 - protein, 18 aa, synthetic construct
KIINGRDSPHKSGQDQQT

SEQ ID NO: 3629 - protein, 18 aa, synthetic construct
KTISGHDSPHKTGHNQQT

SEQ ID NO: 3630 - protein, 18 aa, synthetic construct
KTVNAHDSPHKSGQNQLT

SEQ ID NO: 3631 - protein, 18 aa, synthetic construct
KSINGYDSPHKSGQTQQT

SEQ ID NO: 3632 - protein, 18 aa, synthetic construct
KTINGHESPHKSGQTQQI

SEQ ID NO: 3633 - protein, 18 aa, synthetic construct
KTINGHDSPHKSGQSKQA

SEQ ID NO: 3634 - protein, 18 aa, synthetic construct
KAIIGHESPHKSGQNQQT

SEQ ID NO: 3635 - protein, 18 aa, synthetic construct
KTINGHDSPHKTGQNQPP

SEQ ID NO: 3636 - protein, 18 aa, synthetic construct
KAINGHDSPHKSGQSPQT

SEQ ID NO: 3637 - protein, 18 aa, synthetic construct
KTIKGNDSPHKSVQNQQT

SEQ ID NO: 3638 - protein, 18 aa, synthetic construct
KTEFGHDSPHKSGQNQQT

SEQ ID NO: 3639 - protein, 18 aa, synthetic construct
KTINGHDSPHKSAQNYQT

SEQ ID NO: 3640 - protein, 18 aa, synthetic construct
KTINAHDSPHKIGQNHQT

SEQ ID NO: 3641 - protein, 18 aa, synthetic construct
KTINGHESPHKSAQNRQT

SEQ ID NO: 3642 - protein, 18 aa, synthetic construct
KTTNGHDSPHKSGQNQQG

SEQ ID NO: 3643 - protein, 18 aa, synthetic construct
KTIKGQDSPHKIGQNQQT

SEQ ID NO: 3644 - protein, 18 aa, synthetic construct
KTVNGHDSPHKSGQNHLT

SEQ ID NO: 3645 - protein, 18 aa, synthetic construct
KSINGHDSPHKSGQYQHT

SEQ ID NO: 3646 - protein, 18 aa, synthetic construct
KTINGNDSPHKSVQNHQT

SEQ ID NO: 3647 - protein, 18 aa, synthetic construct
KTITGHDSPHKSGQNQWT

SEQ ID NO: 3648 - protein, 18 aa, synthetic construct
KTNNGHDSPHKSVQNQHT

SEQ ID NO: 3649 - protein, 18 aa, synthetic construct
KTIDGHDSPHKSGQNQHA

SEQ ID NO: 3650 - protein, 18 aa, synthetic construct
KTVNGHDSPHKSGQTRQT

SEQ ID NO: 3651 - protein, 18 aa, synthetic construct
KTVNGHDSPHKSGQNLHT

SEQ ID NO: 3652 - protein, 18 aa, synthetic construct
KAISGHDSPHKSGLNQQT

SEQ ID NO: 3653 - protein, 18 aa, synthetic construct
KAINGHDSPHKSAQNQET

SEQ ID NO: 3654 - protein, 18 aa, synthetic construct
KTITGHDSPHKSGQHLQT

SEQ ID NO: 3655 - protein, 18 aa, synthetic construct
KTINGHDSPHKSRLNQPT

SEQ ID NO: 3656 - protein, 18 aa, synthetic construct
KTVDGHDSPHKSGQKQQT

SEQ ID NO: 3657 - protein, 18 aa, synthetic construct
KTINGQDSPHKSGQNQDT

SEQ ID NO: 3658 - protein, 18 aa, synthetic construct
KTIEGHDSPHKSGRNQQT

SEQ ID NO: 3659 - protein, 18 aa, synthetic construct
KTTNGHDSPHKSGQNLLT

SEQ ID NO: 3660 - protein, 18 aa, synthetic construct
KTINGHDSPHKSGQLVIT

SEQ ID NO: 3661 - protein, 18 aa, synthetic construct
KTVNGHDSPHKSRQSQQT

SEQ ID NO: 3662 - protein, 18 aa, synthetic construct
KTINGHDSPHKSGRTQET

SEQ ID NO: 3663 - protein, 18 aa, synthetic construct
KTINGHDSPHKSVQTHQT

SEQ ID NO: 3664 - protein, 18 aa, synthetic construct
KTSNGHDSPHKSGQNQPA

SEQ ID NO: 3665 - protein, 18 aa, synthetic construct
KTEGKHDSPHKSGQNQQT

SEQ ID NO: 3666 - protein, 18 aa, synthetic construct
KVINGHDSPHKSGQTQQT

SEQ ID NO: 3667 - protein, 18 aa, synthetic construct
KTINGPDSPHKIGQNQQS

SEQ ID NO: 3668 - protein, 18 aa, synthetic construct
KAVNGHDSPHKSVQNQQT

SEQ ID NO: 3669 - protein, 18 aa, synthetic construct
KTINGHDSPHKSRQDQHT

SEQ ID NO: 3670 - protein, 18 aa, synthetic construct
KAINGPDSPHKSGQKQQT

SEQ ID NO: 3671 - protein, 18 aa, synthetic construct
KTINGHDSPHKSRQSQHT

SEQ ID NO: 3672 - protein, 18 aa, synthetic construct
KTIYGHDSPHKSVQNQLT

SEQ ID NO: 3673 - protein, 18 aa, synthetic construct
KTVNGHDSPHKSGQNLLT

SEQ ID NO: 3674 - protein, 18 aa, synthetic construct
KTESAHDSPHKSGQNQQT

SEQ ID NO: 3675 - protein, 18 aa, synthetic construct
KTTNGQDSPHKSGQNQQS

SEQ ID NO: 3676 - protein, 18 aa, synthetic construct
KTIDGHDSPHKSGRNQQI

SEQ ID NO: 3677 - protein, 18 aa, synthetic construct
KTINGYDSPHKSGQYQHT

SEQ ID NO: 3678 - protein, 18 aa, synthetic construct
KTDNGHDSPHKSRQNQQT

SEQ ID NO: 3679 - protein, 18 aa, synthetic construct
KTINGHDSPHKSWVRQQT

SEQ ID NO: 3680 - protein, 18 aa, synthetic construct
KTINGHESPHKSGQNQHS

SEQ ID NO: 3681 - protein, 18 aa, synthetic construct
KTVNGHDSPHKIGHNQQT

SEQ ID NO: 3682 - protein, 18 aa, synthetic construct
KTCNGHDSPHKSGRNQQT

SEQ ID NO: 3683 - protein, 18 aa, synthetic construct
KNVVGHDSPHKSGQNQQT

SEQ ID NO: 3684 - protein, 18 aa, synthetic construct
KTELWHDSPHKSGQNQQT

SEQ ID NO: 3685 - protein, 18 aa, synthetic construct
KTELRHDSPHKSGQNQQT

SEQ ID NO: 3686 - protein, 18 aa, synthetic construct
KTINGHDSPHKSNAWQQT

SEQ ID NO: 3687 - protein, 18 aa, synthetic construct
KTDAGHDSPHKSGQNQQT

SEQ ID NO: 3688 - protein, 18 aa, synthetic construct
KTEVGHDSPHKSGQNQQT

SEQ ID NO: 3689 - protein, 18 aa, synthetic construct
KTESRHDSPHKSGQNQQT

SEQ ID NO: 3690 - protein, 18 aa, synthetic construct
KSELGHDSPHKSGQNQQT

SEQ ID NO: 3691 - protein, 18 aa, synthetic construct
KTINGHDSPHKSGQSVPT

SEQ ID NO: 3692 - protein, 18 aa, synthetic construct
KTINGHESPHKSGQNIQP

SEQ ID NO: 3693 - protein, 18 aa, synthetic construct
KTEMKHDSPHKSGQNQQT

SEQ ID NO: 3694 - protein, 18 aa, synthetic construct
KTINGHDSPHKSVQNHLN

SEQ ID NO: 3695 - protein, 18 aa, synthetic construct
KTINGHDSPHKIGLDQQT

SEQ ID NO: 3696 - protein, 18 aa, synthetic construct
KTINGHDSPHKRGPDQQS

SEQ ID NO: 3697 - protein, 18 aa, synthetic construct
KTIKGHDSPHKSGESQQT

SEQ ID NO: 3698 - protein, 18 aa, synthetic construct
KTEGWHDSPHKSGQNQQT

SEQ ID NO: 3699 - protein, 18 aa, synthetic construct
KTINGHDSPHKHGQNHQT

SEQ ID NO: 3700 - protein, 18 aa, synthetic construct
KTEQLHDSPHKSGQNQQT

SEQ ID NO: 3701 - protein, 18 aa, synthetic construct
KTIIGHDSPHKSGQYQHT

SEQ ID NO: 3702 - protein, 18 aa, synthetic construct
KTSNGHDSPHKSVQNKQT

SEQ ID NO: 3703 - protein, 18 aa, synthetic construct
KIVNGQVSPHKSGQNQQT

SEQ ID NO: 3704 - protein, 18 aa, synthetic construct
KTVNGHDSPHKSGQRQLT

SEQ ID NO: 3705 - protein, 18 aa, synthetic construct
KTVNGHDSPHKIGQNQLT

SEQ ID NO: 3706 - protein, 18 aa, synthetic construct
KTINGHDSPHKSGQIIVT

SEQ ID NO: 3707 - protein, 18 aa, synthetic construct
KTEKIHDSPHKSGQNQQT

SEQ ID NO: 3708 - protein, 18 aa, synthetic construct
KTENAHDSPHKSGQNQQT

SEQ ID NO: 3709 - protein, 18 aa, synthetic construct
KIGNGHESPHKSGQNQQT

SEQ ID NO: 3710 - protein, 18 aa, synthetic construct
KEVMGHDSPHKSGQNQQT

SEQ ID NO: 3711 - protein, 18 aa, synthetic construct
KTEVKHDSPHKSGQNQQT

SEQ ID NO: 3712 - protein, 18 aa, synthetic construct
KTINGYDSPHKSGQKQST

SEQ ID NO: 3713 - protein, 18 aa, synthetic construct
KYQVGHDSPHKSGQNQQT

SEQ ID NO: 3714 - protein, 18 aa, synthetic construct
KTEAMHDSPHKSGQNQQT

SEQ ID NO: 3715 - protein, 18 aa, synthetic construct
KTIKGDDSPHKSVQNQQT

SEQ ID NO: 3716 - protein, 18 aa, synthetic construct
KTINGHDSPHKSVQSHQT

SEQ ID NO: 3717 - protein, 18 aa, synthetic construct
KTINGHDSPHKSGQFVVT

SEQ ID NO: 3718 - protein, 18 aa, synthetic construct
KTVNGHDSPHKSRQNLQT

SEQ ID NO: 3719 - protein, 18 aa, synthetic construct
KATNGHNSPHKSGQNQET

SEQ ID NO: 3720 - protein, 18 aa, synthetic construct
KAINGHDSPHKSAQNQQI

SEQ ID NO: 3721 - protein, 18 aa, synthetic construct
KTEHGHDSPHKSGQNQQT

SEQ ID NO: 3722 - protein, 18 aa, synthetic construct
KTVENHDSPHKSGQNQQT

SEQ ID NO: 3723 - protein, 18 aa, synthetic construct
KTIYGHDSPHKSGQSQPT

SEQ ID NO: 3724 - protein, 18 aa, synthetic construct
KTISGHESPHKSGQNEQT

SEQ ID NO: 3725 - protein, 18 aa, synthetic construct
KAIIGHDSPHKSAQNQQT

SEQ ID NO: 3726 - protein, 18 aa, synthetic construct
KAIDGHDSPHKSGQNQLT

SEQ ID NO: 3727 - protein, 18 aa, synthetic construct
KTIMGHDSPHKSVQNQQT

SEQ ID NO: 3728 - protein, 18 aa, synthetic construct
KEVGGHDSPHKSGQNQQT

SEQ ID NO: 3729 - protein, 18 aa, synthetic construct
KTINGHDSPHKSAQNLLT

SEQ ID NO: 3730 - protein, 18 aa, synthetic construct
KTEFTHDSPHKSGQNQQT

SEQ ID NO: 3731 - protein, 18 aa, synthetic construct
KSEMGHDSPHKSGQNQQT

SEQ ID NO: 3732 - protein, 18 aa, synthetic construct
KAQQGHDSPHKSGQNQQT

SEQ ID NO: 3733 - protein, 18 aa, synthetic construct
KTEVMHDSPHKSGQNQQT

SEQ ID NO: 3734 - protein, 18 aa, synthetic construct
KAINGHDSPHKSGQSLQT

SEQ ID NO: 3735 - protein, 18 aa, synthetic construct
KCGEGHDSPHKSGQNQQT

SEQ ID NO: 3736 - protein, 18 aa, synthetic construct
KTVNGHDSPHKSAQNHQT

SEQ ID NO: 3737 - protein, 18 aa, synthetic construct
KTVNGHDSPHKSGQTQLT

SEQ ID NO: 3738 - protein, 18 aa, synthetic construct
KTNNGHDSPHKSGRNRQT

SEQ ID NO: 3739 - protein, 18 aa, synthetic construct
KTCNEHDSPHKSGQNQQT

SEQ ID NO: 3740 - protein, 18 aa, synthetic construct
KTINGHDSPHKYGQNEQT

SEQ ID NO: 3741 - protein, 18 aa, synthetic construct
KASNRHDSPHKSGHNQQT

SEQ ID NO: 3742 - protein, 18 aa, synthetic construct
KTETKHDSPHKSGQNQQT

SEQ ID NO: 3743 - protein, 18 aa, synthetic construct
KSINGHDSPHKSQQNQQT

SEQ ID NO: 3744 - protein, 18 aa, synthetic construct
KTIGGHDSPHKSGQNQQI

SEQ ID NO: 3745 - protein, 18 aa, synthetic construct
KTDPQHDSPHKSGQNQQT

SEQ ID NO: 3746 - protein, 18 aa, synthetic construct
KTINRHDSPHKIVQNQQT

SEQ ID NO: 3747 - protein, 18 aa, synthetic construct
KTEQYHDSPHKSGQNQQT

SEQ ID NO: 3748 - protein, 18 aa, synthetic construct
KTINGHDSPHKSVQSKQT

SEQ ID NO: 3749 - protein, 18 aa, synthetic construct
KELVGHDSPHKSGQNQQT

SEQ ID NO: 3750 - protein, 18 aa, synthetic construct
KTENRHDSPHKSGQNQQT

SEQ ID NO: 3751 - protein, 18 aa, synthetic construct
KELMGHDSPHKSGQNQQT

SEQ ID NO: 3752 - protein, 18 aa, synthetic construct
KTINGNDSPHKIGHNQQT

SEQ ID NO: 3753 - protein, 18 aa, synthetic construct
KTEGHHDSPHKSGQNQQT

SEQ ID NO: 3754 - protein, 18 aa, synthetic construct
KTEGYHDSPHKSGQNQQT

SEQ ID NO: 3755 - protein, 18 aa, synthetic construct
KTVNGHDSPHKSGQTQQI

SEQ ID NO: 3756 - protein, 18 aa, synthetic construct
KTINGQDSPHKSGQNPLT

SEQ ID NO: 3757 - protein, 18 aa, synthetic construct
KTINGHDSPHKSGRDQKT

SEQ ID NO: 3758 - protein, 18 aa, synthetic construct
KTINGHDSPHKSVHNQQN

SEQ ID NO: 3759 - protein, 18 aa, synthetic construct
KTINGHDSPHKSGQWKRT

SEQ ID NO: 3760 - protein, 18 aa, synthetic construct
KNEIGHDSPHKSGQNQQT

SEQ ID NO: 3761 - protein, 18 aa, synthetic construct
KAINGHDSPHKSGQSQQI

SEQ ID NO: 3762 - protein, 18 aa, synthetic construct
KIINGHDSPHKSRQAQQT

SEQ ID NO: 3763 - protein, 18 aa, synthetic construct
KTPNGHDSPHKSGQNQQI

SEQ ID NO: 3764 - protein, 18 aa, synthetic construct
KITNGHDSPHKSGQTQQT

SEQ ID NO: 3765 - protein, 18 aa, synthetic construct
KTINGHDSPHKSVQNHQI

SEQ ID NO: 3766 - protein, 18 aa, synthetic construct
KTINGHDSPHKSKQNQQA

SEQ ID NO: 3767 - protein, 18 aa, synthetic construct
KTINGHDSPHKSAQNQLN

SEQ ID NO: 3768 - protein, 18 aa, synthetic construct
KTDITHDSPHKSGQNQQT

SEQ ID NO: 3769 - protein, 18 aa, synthetic construct
KTVNGHDSPHKSGQTQPT

SEQ ID NO: 3770 - protein, 18 aa, synthetic construct
KTEKFHDSPHKSGQNQQT

SEQ ID NO: 3771 - protein, 18 aa, synthetic construct
KTDQGHDSPHKSGQNQQT

SEQ ID NO: 3772 - protein, 18 aa, synthetic construct
KTINGHDSPHKLWINQQT

SEQ ID NO: 3773 - protein, 18 aa, synthetic construct
KGINGPDSPHKSGQNQQT

SEQ ID NO: 3774 - protein, 18 aa, synthetic construct
KSEIGHDSPHKSGQNQQT

SEQ ID NO: 3775 - protein, 18 aa, synthetic construct
KTINGHDSPHKSVQKQLT

SEQ ID NO: 3776 - protein, 18 aa, synthetic construct
KTVNGHDSPHKSGRNQLA

SEQ ID NO: 3777 - protein, 18 aa, synthetic construct
KTNNVHDSPHKSGQNQQS

SEQ ID NO: 3778 - protein, 18 aa, synthetic construct
KSEKGHDSPHKSGQNQQT

SEQ ID NO: 3779 - protein, 18 aa, synthetic construct
KWSAGHDSPHKSGQNQQT

SEQ ID NO: 3780 - protein, 18 aa, synthetic construct
KELAGHDSPHKSGQNQQT

SEQ ID NO: 3781 - protein, 18 aa, synthetic construct
KTINGHDSPHKMGRNQQS

SEQ ID NO: 3782 - protein, 18 aa, synthetic construct
KTDQAHDSPHKSGQNQQT

SEQ ID NO: 3783 - protein, 18 aa, synthetic construct
KTETQHDSPHKSGQNQQT

SEQ ID NO: 3784 - protein, 18 aa, synthetic construct
KTEMTHDSPHKSGQNQQT

SEQ ID NO: 3785 - protein, 18 aa, synthetic construct
KTINGHDSPHKSGISIQT

SEQ ID NO: 3786 - protein, 18 aa, synthetic construct
KTDAVHDSPHKSGQNQQT

SEQ ID NO: 3787 - protein, 18 aa, synthetic construct
KTSNGHDSPHKSVQNLQT

SEQ ID NO: 3788 - protein, 18 aa, synthetic construct
KTEKYHDSPHKSGQNQQT

SEQ ID NO: 3789 - protein, 18 aa, synthetic construct
KQTQGHDSPHKSGQNQQT

SEQ ID NO: 3790 - protein, 18 aa, synthetic construct
KTINGHDSPHKMAHNQQT

SEQ ID NO: 3791 - protein, 18 aa, synthetic construct
KTINGHDSPHKHGQNQQN

SEQ ID NO: 3792 - protein, 18 aa, synthetic construct
KGADGHDSPHKSGQNQQT

SEQ ID NO: 3793 - protein, 18 aa, synthetic construct
KVGEGHDSPHKSGQNQQT

SEQ ID NO: 3794 - protein, 18 aa, synthetic construct
KANEGHDSPHKSGQNQQT

SEQ ID NO: 3795 - protein, 18 aa, synthetic construct
KTDTMHDSPHKSGQNQQT

SEQ ID NO: 3796 - protein, 18 aa, synthetic construct
KTINGHDSPHKSVQSQQS

SEQ ID NO: 3797 - protein, 18 aa, synthetic construct
KTCIAHDSPHKSGQNQQT

SEQ ID NO: 3798 - protein, 18 aa, synthetic construct
KTINGHDSPHKSGQTVCT

SEQ ID NO: 3799 - protein, 18 aa, synthetic construct
KELRGHDSPHKSGQNQQT

SEQ ID NO: 3800 - protein, 18 aa, synthetic construct
KCQIGHDSPHKSGQNQQT

SEQ ID NO: 3801 - protein, 18 aa, synthetic construct
KGVMGHDSPHKSGQNQQT

SEQ ID NO: 3802 - protein, 18 aa, synthetic construct
KACDGHDSPHKSGQNQQT

SEQ ID NO: 3803 - protein, 18 aa, synthetic construct
KTINGQDSPHKSGQYQQI

SEQ ID NO: 3804 - protein, 18 aa, synthetic construct
KTINGHDSPHKSGQQIMT

SEQ ID NO: 3805 - protein, 18 aa, synthetic construct
KTINGHDSPHKSRQNEQS

SEQ ID NO: 3806 - protein, 18 aa, synthetic construct
KASNGHDSPHKSGLNHQT

SEQ ID NO: 3807 - protein, 18 aa, synthetic construct
KTVNGHDSPHKSGQSQPT

SEQ ID NO: 3808 - protein, 18 aa, synthetic construct
KNELGHDSPHKSGQNQQT

SEQ ID NO: 3809 - protein, 18 aa, synthetic construct
KTETFHDSPHKSGQNQQT

SEQ ID NO: 3810 - protein, 18 aa, synthetic construct
KAAEGHDSPHKSGQNQQT

SEQ ID NO: 3811 - protein, 18 aa, synthetic construct
KGQNGHDSPHKSGQNQQT

SEQ ID NO: 3812 - protein, 18 aa, synthetic construct
KNEFGHDSPHKSGQNQQT

SEQ ID NO: 3813 - protein, 18 aa, synthetic construct
KTSIGYDSPHKSGQNQQT

SEQ ID NO: 3814 - protein, 18 aa, synthetic construct
KTDNGHDSPHKSGQNLQT

SEQ ID NO: 3815 - protein, 18 aa, synthetic construct
KTEGQHDSPHKSGQNQQT

SEQ ID NO: 3816 - protein, 18 aa, synthetic construct
KTITGHDSPHKSRQDQQT

SEQ ID NO: 3817 - protein, 18 aa, synthetic construct
KAEHGHDSPHKSGQNQQT

SEQ ID NO: 3818 - protein, 18 aa, synthetic construct
KTINGDDSPHKSGQKQLT

SEQ ID NO: 3819 - protein, 18 aa, synthetic construct
KCDQGHDSPHKSGQNQQT

SEQ ID NO: 3820 - protein, 18 aa, synthetic construct
KEILGHDSPHKSGQNQQT

SEQ ID NO: 3821 - protein, 18 aa, synthetic construct
KTERNHDSPHKSGQNQQT

SEQ ID NO: 3822 - protein, 18 aa, synthetic construct
KAINGDDSPHKSGHNQQT

SEQ ID NO: 3823 - protein, 18 aa, synthetic construct
KTSNGHNSPHKSGQNQET

SEQ ID NO: 3824 - protein, 18 aa, synthetic construct
KTINGHDSPHKSGQMIHT

SEQ ID NO: 3825 - protein, 18 aa, synthetic construct
KNAIGHDSPHKSGQNQQT

SEQ ID NO: 3826 - protein, 18 aa, synthetic construct
KTDKFHDSPHKSGQNQQT

SEQ ID NO: 3827 - protein, 18 aa, synthetic construct
KTEGFHDSPHKSGQNQQT

SEQ ID NO: 3828 - protein, 18 aa, synthetic construct
KVINGHDSPHKSGRNHQS

SEQ ID NO: 3829 - protein, 18 aa, synthetic construct
KTITGHDSPHKSVQNRQT

SEQ ID NO: 3830 - protein, 18 aa, synthetic construct
KTPDMHDSPHKSGQNQQT

SEQ ID NO: 3831 - protein, 18 aa, synthetic construct
KTINGHDSPHKSGQKMNT

SEQ ID NO: 3832 - protein, 18 aa, synthetic construct
KTELQHDSPHKSGQNQQT

SEQ ID NO: 3833 - protein, 18 aa, synthetic construct
KTIHGHDSPHKSGQSQQN

SEQ ID NO: 3834 - protein, 18 aa, synthetic construct
KTEIGHDSPHKSGQNQQT

SEQ ID NO: 3835 - protein, 18 aa, synthetic construct
KTINGHDSPHKSGQYQHA

SEQ ID NO: 3836 - protein, 18 aa, synthetic construct
KTELYHDSPHKSGQNQQT

SEQ ID NO: 3837 - protein, 18 aa, synthetic construct
KTINGRGSPHKRGQNQQT

SEQ ID NO: 3838 - protein, 18 aa, synthetic construct
KTINGHGSPHSKAQNPQT

SEQ ID NO: 3839 - protein, 18 aa, synthetic construct
KTFNGSASPHSKALNQQT

SEQ ID NO: 3840 - protein, 18 aa, synthetic construct
KTINGCGSPHASGQNQQT

SEQ ID NO: 3841 - protein, 18 aa, synthetic construct
KTINGNGSPHSKAQNHQA

SEQ ID NO: 3842 - protein, 18 aa, synthetic construct
KTINGMGSPHSKTQNQQT

SEQ ID NO: 3843 - protein, 18 aa, synthetic construct
KTVNGTGSPHSKAQNQLT

SEQ ID NO: 3844 - protein, 18 aa, synthetic construct
KTIHGNGSPHSKAQNQET

SEQ ID NO: 3845 - protein, 18 aa, synthetic construct
KAINGNGSPHKRGQNQQT

SEQ ID NO: 3846 - protein, 18 aa, synthetic construct
KTINGNGSPHSKAPNLQT

SEQ ID NO: 3847 - protein, 18 aa, synthetic construct
KTIKGGGSPHSKAQDQQT

SEQ ID NO: 3848 - protein, 18 aa, synthetic construct
KTINGHPSPHWKGQNQQT

SEQ ID NO: 3849 - protein, 18 aa, synthetic construct
KTINGSGSPHIVWQNQQT

SEQ ID NO: 3850 - protein, 18 aa, synthetic construct
KTINGSGSPHSKYFMQQT

SEQ ID NO: 3851 - protein, 18 aa, synthetic construct
KTINGSGSPHSKARQRQT

SEQ ID NO: 3852 - protein, 18 aa, synthetic construct
KTINGSGSPHSCHQNQQT

SEQ ID NO: 3853 - protein, 18 aa, synthetic construct
KTINGSGSPHFPWQNQQT

SEQ ID NO: 3854 - protein, 18 aa, synthetic construct
KTINGSGSPHSKIRRQQT

SEQ ID NO: 3855 - protein, 18 aa, synthetic construct
KTINGSGSPHVYYQNQQT

SEQ ID NO: 3856 - protein, 18 aa, synthetic construct
KTINGSGSPHSLYWNQQT

SEQ ID NO: 3857 - protein, 18 aa, synthetic construct
KTINGSGSPHSKPKRQQT

SEQ ID NO: 3858 - protein, 18 aa, synthetic construct
KPRWGSGSPHSKAQNQQT

SEQ ID NO: 3859 - protein, 18 aa, synthetic construct
KTINGSGSPHSKAFSWQT

SEQ ID NO: 3860 - protein, 18 aa, synthetic construct
KTINGSGSPHSRFWNQQT

SEQ ID NO: 3861 - protein, 18 aa, synthetic construct
KTINGSGSPHSKAQCLKT

SEQ ID NO: 3862 - protein, 18 aa, synthetic construct
KTINGSGSPHSRMRNQQT

SEQ ID NO: 3863 - protein, 18 aa, synthetic construct
KTINGSGSPHSVKKNQQT

SEQ ID NO: 3864 - protein, 18 aa, synthetic construct
KTINGSGSPHSWAPNQQT

SEQ ID NO: 3865 - protein, 18 aa, synthetic construct
KTINGSGSPHSLWKNQQT

SEQ ID NO: 3866 - protein, 18 aa, synthetic construct
KTINGSGSPHSKARWQQT

SEQ ID NO: 3867 - protein, 18 aa, synthetic construct
KTINGSGSPHSFRPNQQT

SEQ ID NO: 3868 - protein, 18 aa, synthetic construct
KTINGSGSPHSKKVFQQT

SEQ ID NO: 3869 - protein, 18 aa, synthetic construct
KTINGSGSPHSYAFNQQT

SEQ ID NO: 3870 - protein, 18 aa, synthetic construct
KTINGSGSPHSKACSRQT

SEQ ID NO: 3871 - protein, 18 aa, synthetic construct
KYSAGSGSPHSKAQNQQT

SEQ ID NO: 3872 - protein, 18 aa, synthetic construct
KTINGSGSPHSKRLWQQT

SEQ ID NO: 3873 - protein, 18 aa, synthetic construct
KTINGSGSPHSCSRNQQT

SEQ ID NO: 3874 - protein, 18 aa, synthetic construct
KTINGSGSPHSRCPNQQT

SEQ ID NO: 3875 - protein, 18 aa, synthetic construct
KTINGSGSPHSGACNQQT

SEQ ID NO: 3876 - protein, 18 aa, synthetic construct
KYYTGSGSPHSKAQNQQT

SEQ ID NO: 3877 - protein, 18 aa, synthetic construct
KTINGSGSPHSKFRQQQT

SEQ ID NO: 3878 - protein, 18 aa, synthetic construct
KTINGSGSPHSFPFNQQT

SEQ ID NO: 3879 - protein, 18 aa, synthetic construct
KTINGSGSPHSFFGNQQT

SEQ ID NO: 3880 - protein, 18 aa, synthetic construct
KTINGSGSPHSMCQNQQT

SEQ ID NO: 3881 - protein, 18 aa, synthetic construct
KTINGSGSPHSKLFWQQT

SEQ ID NO: 3882 - protein, 18 aa, synthetic construct
KTINGSGSPHSKTRKQQT

SEQ ID NO: 3883 - protein, 18 aa, synthetic construct
KTINGSGSPHSGKRNQQT

SEQ ID NO: 3884 - protein, 18 aa, synthetic construct
KTINGSGSPHSKAQNFKR

SEQ ID NO: 3885 - protein, 18 aa, synthetic construct
KTINGSGSPHFYRQNQQT

SEQ ID NO: 3886 - protein, 18 aa, synthetic construct
KTINGSGSPHCRVQNQQT

SEQ ID NO: 3887 - protein, 18 aa, synthetic construct
KTINGSGSPHYGIQNQQT

SEQ ID NO: 3888 - protein, 18 aa, synthetic construct
KTINGSGSPHSKAQRFKT

SEQ ID NO: 3889 - protein, 18 aa, synthetic construct
KTINGSGSPHVNCQNQQT

SEQ ID NO: 3890 - protein, 18 aa, synthetic construct
KTINGSGSPHSKPFRQQT

SEQ ID NO: 3891 - protein, 18 aa, synthetic construct
KTINGSGSPHSLAWNQQT

SEQ ID NO: 3892 - protein, 18 aa, synthetic construct
KTINGSGSPHSKRSYQQT

SEQ ID NO: 3893 - protein, 18 aa, synthetic construct
KTINGSGSPHWSYQNQQT

SEQ ID NO: 3894 - protein, 18 aa, synthetic construct
KTINGSGSPHRWLQNQQT

SEQ ID NO: 3895 - protein, 18 aa, synthetic construct
KTINGSGSPHPSCQNQQT

SEQ ID NO: 3896 - protein, 18 aa, synthetic construct
KTINGSGSPHSSWLNQQT

SEQ ID NO: 3897 - protein, 18 aa, synthetic construct
KPRFGSGSPHSKAQNQQT

SEQ ID NO: 3898 - protein, 18 aa, synthetic construct
KWLTGSGSPHSKAQNQQT

SEQ ID NO: 3899 - protein, 18 aa, synthetic construct
KTINGSGSPHSKRRAQQT

SEQ ID NO: 3900 - protein, 18 aa, synthetic construct
KTINGSGSPHSKAQTCRT

SEQ ID NO: 3901 - protein, 18 aa, synthetic construct
KTINGSGSPHSKGCTQQT

SEQ ID NO: 3902 - protein, 18 aa, synthetic construct
KTINGSGSPHVPWQNQQT

SEQ ID NO: 3903 - protein, 18 aa, synthetic construct
KTINGSGSPHSKRYTQQT

SEQ ID NO: 3904 - protein, 18 aa, synthetic construct
KTINGSGSPHSGCQNQQT

SEQ ID NO: 3905 - protein, 18 aa, synthetic construct
KTINGSGSPHSFTPNQQT

SEQ ID NO: 3906 - protein, 18 aa, synthetic construct
KTINGSGSPHSTTCNQQT

SEQ ID NO: 3907 - protein, 18 aa, synthetic construct
KTINGSGSPHSKARMYQT

SEQ ID NO: 3908 - protein, 18 aa, synthetic construct
KTINGSGSPHPKRQNQQT

SEQ ID NO: 3909 - protein, 18 aa, synthetic construct
KTINGSGSPHSKCFLQQT

SEQ ID NO: 3910 - protein, 18 aa, synthetic construct
KTINGSGSPHWVPQNQQT

SEQ ID NO: 3911 - protein, 18 aa, synthetic construct
KTINGSGSPHSFWSNQQT

SEQ ID NO: 3912 - protein, 18 aa, synthetic construct
KRSYGSGSPHSKAQNQQT

SEQ ID NO: 3913 - protein, 18 aa, synthetic construct
KYVFGSGSPHSKAQNQQT

SEQ ID NO: 3914 - protein, 18 aa, synthetic construct
KTINGSGSPHSKFKNQQT

SEQ ID NO: 3915 - protein, 18 aa, synthetic construct
KTINGSGSPHRIKQNQQT

SEQ ID NO: 3916 - protein, 18 aa, synthetic construct
KTINGSGSPHSKAPRRQT

SEQ ID NO: 3917 - protein, 18 aa, synthetic construct
KTINGSGSPHSFRYNQQT

SEQ ID NO: 3918 - protein, 18 aa, synthetic construct
KTINGSGSPHSKMICQQT

SEQ ID NO: 3919 - protein, 18 aa, synthetic construct
KTINGSGSPHLRWQNQQT

SEQ ID NO: 3920 - protein, 18 aa, synthetic construct
KTINGSGSPHLPTQNQQT

SEQ ID NO: 3921 - protein, 18 aa, synthetic construct
KTINGSGSPHSKWKSQQT

SEQ ID NO: 3922 - protein, 18 aa, synthetic construct
KTINGSGSPHSYMRNQQT

SEQ ID NO: 3923 - protein, 18 aa, synthetic construct
KTINGSGSPHSKAARRQT

SEQ ID NO: 3924 - protein, 18 aa, synthetic construct
KTINGSGSPHLLCQNQQT

SEQ ID NO: 3925 - protein, 18 aa, synthetic construct
KTINGSGSPHRCCQNQQT

SEQ ID NO: 3926 - protein, 18 aa, synthetic construct
KTINGSGSPHLCVQNQQT

SEQ ID NO: 3927 - protein, 18 aa, synthetic construct
KTINGSGSPHSKLTRQQT

SEQ ID NO: 3928 - protein, 18 aa, synthetic construct
KTINGSGSPHSKLCTQQT

SEQ ID NO: 3929 - protein, 18 aa, synthetic construct
KKHLGSGSPHSKAQNQQT

SEQ ID NO: 3930 - protein, 18 aa, synthetic construct
KTINGSGSPHSKIRGQQT

SEQ ID NO: 3931 - protein, 18 aa, synthetic construct
KTINGSGSPHSYLVNQQT

SEQ ID NO: 3932 - protein, 18 aa, synthetic construct
KTINGSGSPHQGCQNQQT

SEQ ID NO: 3933 - protein, 18 aa, synthetic construct
KTINGSGSPHMAFQNQQT

SEQ ID NO: 3934 - protein, 18 aa, synthetic construct
KTINGSGSPHSKACQFQT

SEQ ID NO: 3935 - protein, 18 aa, synthetic construct
KTINGSGSPHSKWGLQQT

SEQ ID NO: 3936 - protein, 18 aa, synthetic construct
KTINGSGSPHSKILRQQT

SEQ ID NO: 3937 - protein, 18 aa, synthetic construct
KTINGSGSPHSFQINQQT

SEQ ID NO: 3938 - protein, 18 aa, synthetic construct
KTINGSGSPHSKACISQT

SEQ ID NO: 3939 - protein, 18 aa, synthetic construct
KTINGSGSPHSKAQTHRT

SEQ ID NO: 3940 - protein, 18 aa, synthetic construct
KTINGSGSPHSKALRCQT

SEQ ID NO: 3941 - protein, 18 aa, synthetic construct
KTINGSGSPHSKAFYIQT

SEQ ID NO: 3942 - protein, 18 aa, synthetic construct
KTINGSGSPHSKAHARQT

SEQ ID NO: 3943 - protein, 18 aa, synthetic construct
KTINGSGSPHSLCLNQQT

SEQ ID NO: 3944 - protein, 18 aa, synthetic construct
KTINGSGSPHSKAFVRQT

SEQ ID NO: 3945 - protein, 18 aa, synthetic construct
KPPLGSGSPHSKAQNQQT

SEQ ID NO: 3946 - protein, 18 aa, synthetic construct
KTINGSGSPHRPWQNQQT

SEQ ID NO: 3947 - protein, 18 aa, synthetic construct
KPARGSGSPHSKAQNQQT

SEQ ID NO: 3948 - protein, 18 aa, synthetic construct
KTINGSGSPHRPRQNQQT

SEQ ID NO: 3949 - protein, 18 aa, synthetic construct
KTINGSGSPHSCPQNQQT

SEQ ID NO: 3950 - protein, 18 aa, synthetic construct
KTINGSGSPHSKAQFILT

SEQ ID NO: 3951 - protein, 18 aa, synthetic construct
KTINGSGSPHSVRYNQQT

SEQ ID NO: 3952 - protein, 18 aa, synthetic construct
KSRRGSGSPHSKAQNQQT

SEQ ID NO: 3953 - protein, 18 aa, synthetic construct
KTINGSGSPHSVRCNQQT

SEQ ID NO: 3954 - protein, 18 aa, synthetic construct
KFFHGSGSPHSKAQNQQT

SEQ ID NO: 3955 - protein, 18 aa, synthetic construct
KTINGSGSPHSKMPCQQT

SEQ ID NO: 3956 - protein, 18 aa, synthetic construct
KTINGSGSPHSKKTSQQT

SEQ ID NO: 3957 - protein, 18 aa, synthetic construct
KRYNGSGSPHSKAQNQQT

SEQ ID NO: 3958 - protein, 18 aa, synthetic construct
KTINGSGSPHSLPYNQQT

SEQ ID NO: 3959 - protein, 18 aa, synthetic construct
KTINGSGSPHVYHQNQQT

SEQ ID NO: 3960 - protein, 18 aa, synthetic construct
KTINGSGSPHSKAQSRKT

SEQ ID NO: 3961 - protein, 18 aa, synthetic construct
KTINGSGSPHSYTRNQQT

SEQ ID NO: 3962 - protein, 18 aa, synthetic construct
KTINGSGSPHLVYQNQQT

SEQ ID NO: 3963 - protein, 18 aa, synthetic construct
KTINGSGSPHSKALRWQT

SEQ ID NO: 3964 - protein, 18 aa, synthetic construct
KTINGSGSPHYRYQNQQT

SEQ ID NO: 3965 - protein, 18 aa, synthetic construct
KTINGSGSPHSWLKNQQT

SEQ ID NO: 3966 - protein, 18 aa, synthetic construct
KTINGSGSPHSKAQMQIT

SEQ ID NO: 3967 - protein, 18 aa, synthetic construct
KTINGSGSPHCPAQNQQT

SEQ ID NO: 3968 - protein, 18 aa, synthetic construct
KTINGSGSPHSMCTNQQT

SEQ ID NO: 3969 - protein, 18 aa, synthetic construct
KTINGSGSPHSPPDNQQT

SEQ ID NO: 3970 - protein, 18 aa, synthetic construct
KTINGSGSPHSKRNYQQT

SEQ ID NO: 3971 - protein, 18 aa, synthetic construct
KTINGSGSPHRWTQNQQT

SEQ ID NO: 3972 - protein, 18 aa, synthetic construct
KTINGSGSPHSKACRLQT

SEQ ID NO: 3973 - protein, 18 aa, synthetic construct
KTINGSGSPHPRKQNQQT

SEQ ID NO: 3974 - protein, 18 aa, synthetic construct
KTINGSGSPHSKCSVQQT

SEQ ID NO: 3975 - protein, 18 aa, synthetic construct
KTINGSGSPHSKAQYVRT

SEQ ID NO: 3976 - protein, 18 aa, synthetic construct
KTINGSGSPHSKARISQT

SEQ ID NO: 3977 - protein, 18 aa, synthetic construct
KTINGSGSPHPFVQNQQT

SEQ ID NO: 3978 - protein, 18 aa, synthetic construct
KTINGSGSPHSKLPKQQT

SEQ ID NO: 3979 - protein, 18 aa, synthetic construct
KTINGSGSPHSKSEQQQT

SEQ ID NO: 3980 - protein, 18 aa, synthetic construct
KTINGSGSPHWVAQNQQT

SEQ ID NO: 3981 - protein, 18 aa, synthetic construct
KTINGSGSPHSLYQNQQT

SEQ ID NO: 3982 - protein, 18 aa, synthetic construct
KTINGSGSPHSKVRMQQT

SEQ ID NO: 3983 - protein, 18 aa, synthetic construct
KTINYTRSPHSKAQNQQT

SEQ ID NO: 3984 - protein, 18 aa, synthetic construct
KTINGSGSPHSSCTNQQT

SEQ ID NO: 3985 - protein, 18 aa, synthetic construct
KTINGSGSPHSKNSRQQT

SEQ ID NO: 3986 - protein, 18 aa, synthetic construct
KTINGSGSPHSKRKRQQT

SEQ ID NO: 3987 - protein, 18 aa, synthetic construct
KTINGSGSPHLCTQNQQT

SEQ ID NO: 3988 - protein, 18 aa, synthetic construct
KTINGSGSPHSKAQSAKT

SEQ ID NO: 3989 - protein, 18 aa, synthetic construct
KTINGSGSPHSTCLNQQT

SEQ ID NO: 3990 - protein, 18 aa, synthetic construct
KTINGSGSPHSYARNQQT

SEQ ID NO: 3991 - protein, 18 aa, synthetic construct
KTINGSGSPHSKQRPQQT

SEQ ID NO: 3992 - protein, 18 aa, synthetic construct
KTINGSGSPHSKRVVQQT

SEQ ID NO: 3993 - protein, 18 aa, synthetic construct
KRFSGSGSPHSKAQNQQT

SEQ ID NO: 3994 - protein, 18 aa, synthetic construct
KTINGSGSPHKSGQNPQT

SEQ ID NO: 3995 - protein, 18 aa, synthetic construct
KTINGSGSPHSKALRHQT

SEQ ID NO: 3996 - protein, 18 aa, synthetic construct
KTINGSGSPHSYYSNQQT

SEQ ID NO: 3997 - protein, 18 aa, synthetic construct
KTINGSGSPHSLTCNQQT

SEQ ID NO: 3998 - protein, 18 aa, synthetic construct
KTINGSGSPHSCQSNQQT

SEQ ID NO: 3999 - protein, 18 aa, synthetic construct
KTINGSGSPHSKAQSIKT

SEQ ID NO: 4000 - protein, 18 aa, synthetic construct
KYSMGSGSPHSKAQNQQT

SEQ ID NO: 4001 - protein, 18 aa, synthetic construct
KTINGSGSPHSKAKGWQT

SEQ ID NO: 4002 - protein, 18 aa, synthetic construct
KTIVGSGSPHSKPQNQQT

SEQ ID NO: 4003 - protein, 18 aa, synthetic construct
KTINGSGSPHFPFQNQQT

SEQ ID NO: 4004 - protein, 18 aa, synthetic construct
KPFLGSGSPHSKAQNQQT

SEQ ID NO: 4005 - protein, 18 aa, synthetic construct
KTINGSGSPHSKCTSQQT

SEQ ID NO: 4006 - protein, 18 aa, synthetic construct
KTINGSGSPHSVFENQQT

SEQ ID NO: 4007 - protein, 18 aa, synthetic construct
KTINGSGSPHSKAKKVQT

SEQ ID NO: 4008 - protein, 18 aa, synthetic construct
KTINGSGSPHSKAQRCST

SEQ ID NO: 4009 - protein, 18 aa, synthetic construct
KTINGSGSPHSKAQFCLT

SEQ ID NO: 4010 - protein, 18 aa, synthetic construct
KTINGSGSPHGRYQNQQT

SEQ ID NO: 4011 - protein, 18 aa, synthetic construct
KTQRKSGSPHSKAQNQQT

SEQ ID NO: 4012 - protein, 18 aa, synthetic construct
KTINGSYSPHCLAQNQQT

SEQ ID NO: 4013 - protein, 18 aa, synthetic construct
KTINGSLSPHFWAQNQQT

SEQ ID NO: 4014 - protein, 18 aa, synthetic construct
KTINHRISPHSKAQNQQT

SEQ ID NO: 4015 - protein, 18 aa, synthetic construct
KTRRPSGSPHSKAQNQQT

SEQ ID NO: 4016 - protein, 18 aa, synthetic construct
KTINGAYSPHRKAQNQQT

SEQ ID NO: 4017 - protein, 18 aa, synthetic construct
KTINGRRSPHGKAQNQQT

SEQ ID NO: 4018 - protein, 18 aa, synthetic construct
KTINGRTSPHRKAQNQQT

SEQ ID NO: 4019 - protein, 18 aa, synthetic construct
KTINGSRSPHAWAQNQQT

SEQ ID NO: 4020 - protein, 18 aa, synthetic construct
KTINKCLSPHSKAQNQQT

SEQ ID NO: 4021 - protein, 18 aa, synthetic construct
KTINGSSSPHRCAQNQQT

SEQ ID NO: 4022 - protein, 18 aa, synthetic construct
KTINCRTSPHSKAQNQQT

SEQ ID NO: 4023 - protein, 18 aa, synthetic construct
KTIFDCGSPHSKAQNQQT

SEQ ID NO: 4024 - protein, 18 aa, synthetic construct
KTINSPRSPHSKAQNQQT

SEQ ID NO: 4025 - protein, 18 aa, synthetic construct
KTINGLDSPHRSRQNQQT

SEQ ID NO: 4026 - protein, 18 aa, synthetic construct
KTRTRSGSPHSKAQNQQT

SEQ ID NO: 4027 - protein, 18 aa, synthetic construct
KTINGSISPHCPAQNQQT

SEQ ID NO: 4028 - protein, 18 aa, synthetic construct
KTINGLVSPHRKAQNQQT

SEQ ID NO: 4029 - protein, 18 aa, synthetic construct
KTINALRSPHSKAQNQQT

SEQ ID NO: 4030 - protein, 18 aa, synthetic construct
KTICGRGSPHSKAQNQQT

SEQ ID NO: 4031 - protein, 18 aa, synthetic construct
KTTRKSGSPHSKAQNQQT

SEQ ID NO: 4032 - protein, 18 aa, synthetic construct
KTMQRSGSPHSKAQNQQT

SEQ ID NO: 4033 - protein, 18 aa, synthetic construct
KTINGSSSPHWMAQNQQT

SEQ ID NO: 4034 - protein, 18 aa, synthetic construct
KTRKRSGSPHSKAQNQQT

SEQ ID NO: 4035 - protein, 18 aa, synthetic construct
KTINFTRSPHSKAQNQQT

SEQ ID NO: 4036 - protein, 18 aa, synthetic construct
KTINNLRSPHSKAQNQQT

SEQ ID NO: 4037 - protein, 18 aa, synthetic construct
KTINGRPSPHGKAQNQQT

SEQ ID NO: 4038 - protein, 18 aa, synthetic construct
KTINWSRSPHSKAQNQQT

SEQ ID NO: 4039 - protein, 18 aa, synthetic construct
KTINGTRSPHKKAQNQQT

SEQ ID NO: 4040 - protein, 18 aa, synthetic construct
KTINGSVSPHCTAQNQQT

SEQ ID NO: 4041 - protein, 18 aa, synthetic construct
KTTRCSGSPHSKAQNQQT

SEQ ID NO: 4042 - protein, 18 aa, synthetic construct
KTKLCSGSPHSKAQNQQT

SEQ ID NO: 4043 - protein, 18 aa, synthetic construct
KTINLGCSPHSKAQNQQT

SEQ ID NO: 4044 - protein, 18 aa, synthetic construct
KTISGHDSPHISGQYQQT

SEQ ID NO: 4045 - protein, 18 aa, synthetic construct
KTINGRRSPHMKAQNQQT

SEQ ID NO: 4046 - protein, 18 aa, synthetic construct
KTINGPWSPHRKAQNQQT

SEQ ID NO: 4047 - protein, 18 aa, synthetic construct
KTINSCFSPHSKAQNQQT

SEQ ID NO: 4048 - protein, 18 aa, synthetic construct
KTIKRYGSPHSKAQNQQT

SEQ ID NO: 4049 - protein, 18 aa, synthetic construct
KTINRYSSPHSKAQNQQT

SEQ ID NO: 4050 - protein, 18 aa, synthetic construct
KTTGRSGSPHSKAQNQQT

SEQ ID NO: 4051 - protein, 18 aa, synthetic construct
KTINRQFSPHSKAQNQQT

SEQ ID NO: 4052 - protein, 18 aa, synthetic construct
KTITGHDSPHSKAQNQQT

SEQ ID NO: 4053 - protein, 18 aa, synthetic construct
KTINGSGSPHKSGQYQQT

SEQ ID NO: 4054 - protein, 18 aa, synthetic construct
KTINGSGSPHKSGQDQQT

SEQ ID NO: 4055 - protein, 18 aa, synthetic construct
KTINGSGSPHKSGQIQQT

SEQ ID NO: 4056 - protein, 18 aa, synthetic construct
KTINGSGSPHKSGRNQQT

SEQ ID NO: 4057 - protein, 18 aa, synthetic construct
KTINGSGSPHKSGKNQQT

SEQ ID NO: 4058 - protein, 18 aa, synthetic construct
KTIYGHDSPHSKAQNQQT

SEQ ID NO: 4059 - protein, 18 aa, synthetic construct
KTINGSGSPHKSGQNQQS

SEQ ID NO: 4060 - protein, 18 aa, synthetic construct
KTINGSGSPHKSGQNLQT

SEQ ID NO: 4061 - protein, 18 aa, synthetic construct
KAINGHDSPHSKAQNQQT

SEQ ID NO: 4062 - protein, 18 aa, synthetic construct
KTVNGHDSPHSKAQNQQT

SEQ ID NO: 4063 - protein, 18 aa, synthetic construct
KTIKGHDSPHSKAQNQQT

SEQ ID NO: 4064 - protein, 18 aa, synthetic construct
KSINGHDSPHSKAQNQQT

SEQ ID NO: 4065 - protein, 18 aa, synthetic construct
KTINGSGSPHKSGQTQQT

SEQ ID NO: 4066 - protein, 18 aa, synthetic construct
KTINGSGSPHKSGHNQQT

SEQ ID NO: 4067 - protein, 18 aa, synthetic construct
KTFNGHDSPHSKAQNQQT

SEQ ID NO: 4068 - protein, 18 aa, synthetic construct
KTINGSGSPHKSGLNQQT

SEQ ID NO: 4069 - protein, 18 aa, synthetic construct
KTINGHDSPHSKALNQQT

SEQ ID NO: 4070 - protein, 18 aa, synthetic construct
KTINGSGSPHKSGQNQLT

SEQ ID NO: 4071 - protein, 18 aa, synthetic construct
KTLNGHDSPHSKAQNQQT

SEQ ID NO: 4072 - protein, 18 aa, synthetic construct
KTINGSGSPHKSGQNQHT

SEQ ID NO: 4073 - protein, 18 aa, synthetic construct
KTIDGHDSPHSKAQNQQT

SEQ ID NO: 4074 - protein, 18 aa, synthetic construct
KTNNGHDSPHSKAQNQQT

SEQ ID NO: 4075 - protein, 18 aa, synthetic construct
KTINGSGSPHKSGQKQQT

SEQ ID NO: 4076 - protein, 18 aa, synthetic construct
KTINGSGSPHKSGQNRQT

SEQ ID NO: 4077 - protein, 18 aa, synthetic construct
KTINGSGSPHKSGQNQQN

SEQ ID NO: 4078 - protein, 18 aa, synthetic construct
KTINGSGSPHKSGQNQQA

SEQ ID NO: 4079 - protein, 18 aa, synthetic construct
KTINGHDSPHSKAHNQQT

SEQ ID NO: 4080 - protein, 18 aa, synthetic construct
KTINGHDSPHSKAQNQQT

SEQ ID NO: 4081 - protein, 18 aa, synthetic construct
KTINGSGSPHKSGQNQQP

SEQ ID NO: 4082 - protein, 18 aa, synthetic construct
KTINGHDSPHCKAQNQQT

SEQ ID NO: 4083 - protein, 18 aa, synthetic construct
KTINGHDSPHSKAQNQQS

SEQ ID NO: 4084 - protein, 18 aa, synthetic construct
KTINGSGSPHKSGQNQQT

SEQ ID NO: 4085 - protein, 18 aa, synthetic construct
KTINGHDSPDKSGQNQQT

SEQ ID NO: 4086 - protein, 18 aa, synthetic construct
KPINGHDSPHKSGQNHQS

SEQ ID NO: 4087 - protein, 18 aa, synthetic construct
KTSNGSGSPHKSGQNQQT

SEQ ID NO: 4088 - protein, 18 aa, synthetic construct
KTVNGSGSPHKSGQNQQT

SEQ ID NO: 4089 - protein, 18 aa, synthetic construct
KTINGHDSTHKSGHNQQT

SEQ ID NO: 4090 - protein, 18 aa, synthetic construct
KTINGHDSPHSKAQNQQN

SEQ ID NO: 4091 - protein, 18 aa, synthetic construct
KTIYGSGSPHKSGQNQQT

SEQ ID NO: 4092 - protein, 18 aa, synthetic construct
KTINGLDSQHKSGQNQQT

SEQ ID NO: 4093-4094 - skipped (2 entries)

SEQ ID NO: 4095 - protein, 18 aa, synthetic construct
KTIIGHDSPHSKAQNQQT

SEQ ID NO: 4096 - protein, 18 aa, synthetic construct
KTSNGHDSPHSKAQNQQT

SEQ ID NO: 4097 - protein, 18 aa, synthetic construct
KTINGSGSPHSKAQNRRR

SEQ ID NO: 4098 - protein, 18 aa, synthetic construct
KTISKRGSPHSKAQNQQT

SEQ ID NO: 4099 - protein, 18 aa, synthetic construct
KGLGGSGSPHSKAQNQQT

SEQ ID NO: 4100 - protein, 18 aa, synthetic construct
KTINGHDSPHSKAQNLQT

SEQ ID NO: 4101 - protein, 18 aa, synthetic construct
KTINGHDSPHSKAQNQQI

SEQ ID NO: 4102 - protein, 18 aa, synthetic construct
KTINGSGSPHFTRQNQQT

SEQ ID NO: 4103 - protein, 18 aa, synthetic construct
KTINGSGSPHSLPWNQQT

SEQ ID NO: 4104 - protein, 18 aa, synthetic construct
KTINGHDSPHSKAQNHQT

SEQ ID NO: 4105 - protein, 18 aa, synthetic construct
KTMNGHDSPHSKAQNQQT

SEQ ID NO: 4106 - protein, 18 aa, synthetic construct
KPYKGSGSPHSKAQNQQT

SEQ ID NO: 4107 - protein, 18 aa, synthetic construct
KRLWGSGSPHSKAQNQQT

SEQ ID NO: 4108 - protein, 18 aa, synthetic construct
KRMRGSGSPHSKAQNQQT

SEQ ID NO: 4109 - protein, 18 aa, synthetic construct
KRTYGSGSPHSKAQNQQT

SEQ ID NO: 4110 - protein, 18 aa, synthetic construct
KTINCLRSPHSKAQNQQT

SEQ ID NO: 4111 - protein, 18 aa, synthetic construct
KTINFSRSPHSKAQNQQT

SEQ ID NO: 4112 - protein, 18 aa, synthetic construct
KTINGLRSPHFKAQNQQT

SEQ ID NO: 4113 - protein, 18 aa, synthetic construct
KTINGNRSPHNKAQNQQT

SEQ ID NO: 4114 - protein, 18 aa, synthetic construct
KTINGPRSPHYKAQNQQT

SEQ ID NO: 4115 - protein, 18 aa, synthetic construct
KTINGQASPHWKAQNQQT

SEQ ID NO: 4116 - protein, 18 aa, synthetic construct
KTINGRCSPHSKAQNQQT

SEQ ID NO: 4117 - protein, 18 aa, synthetic construct
KTINGRHSPHSKAQNQQT

SEQ ID NO: 4118 - protein, 18 aa, synthetic construct
KTINGRKSPHRKAQNQQT

SEQ ID NO: 4119 - protein, 18 aa, synthetic construct
KTINGRLSPHWKAQNQQT

SEQ ID NO: 4120 - protein, 18 aa, synthetic construct
KTINGRLSPHYKAQNQQT

SEQ ID NO: 4121 - protein, 18 aa, synthetic construct
KTINGRPSPHMKAQNQQT

SEQ ID NO: 4122 - protein, 18 aa, synthetic construct
KTINGRSSPHWKAQNQQT

SEQ ID NO: 4123 - protein, 18 aa, synthetic construct
KTINGRWSPHSKAQNQQT

SEQ ID NO: 4124 - protein, 18 aa, synthetic construct
KTINGSGSPHAPCQNQQT

SEQ ID NO: 4125 - protein, 18 aa, synthetic construct
KTINGSGSPHAWAQNQQT

SEQ ID NO: 4126 - protein, 18 aa, synthetic construct
KTINGSGSPHCMRQNQQT

SEQ ID NO: 4127 - protein, 18 aa, synthetic construct
KTINGSGSPHFCSQNQQT

SEQ ID NO: 4128 - protein, 18 aa, synthetic construct
KTINGSGSPHFLFQNQQT

SEQ ID NO: 4129 - protein, 18 aa, synthetic construct
KTINGSGSPHFWAQNQQT

SEQ ID NO: 4130 - protein, 18 aa, synthetic construct
KTINGSGSPHLCAQNQQT

SEQ ID NO: 4131 - protein, 18 aa, synthetic construct
KTINGSGSPHLRYQNQQT

SEQ ID NO: 4132 - protein, 18 aa, synthetic construct
KTINGSGSPHLYYQNQQT

SEQ ID NO: 4133 - protein, 18 aa, synthetic construct
KTINGSGSPHPLCQNQQT

SEQ ID NO: 4134 - protein, 18 aa, synthetic construct
KTINGSGSPHRIRQNQQT

SEQ ID NO: 4135 - protein, 18 aa, synthetic construct
KTINGSGSPHRLFQNQQT

SEQ ID NO: 4136 - protein, 18 aa, synthetic construct
KTINGSGSPHSCGQNQQT

SEQ ID NO: 4137 - protein, 18 aa, synthetic construct
KTINGSGSPHSCLRNQQT

SEQ ID NO: 4138 - protein, 18 aa, synthetic construct
KTINGSGSPHSCLSNQQT

SEQ ID NO: 4139 - protein, 18 aa, synthetic construct
KTINGSGSPHSCRLNQQT

SEQ ID NO: 4140 - protein, 18 aa, synthetic construct
KTINGSGSPHSCSLNQQT

SEQ ID NO: 4141 - protein, 18 aa, synthetic construct
KTINGSGSPHSKACTLQT

SEQ ID NO: 4142 - protein, 18 aa, synthetic construct
KTINGSGSPHSKAFRAQT

SEQ ID NO: 4143 - protein, 18 aa, synthetic construct
KTINGSGSPHSKAIRKQT

SEQ ID NO: 4144 - protein, 18 aa, synthetic construct
KTINGSGSPHSKAQASRT

SEQ ID NO: 4145 - protein, 18 aa, synthetic construct
KTINGSGSPHSKAQFELT

SEQ ID NO: 4146 - protein, 18 aa, synthetic construct
KTINGSGSPHSKAQIVIT

SEQ ID NO: 4147 - protein, 18 aa, synthetic construct
KTINGSGSPHSKAQLART

SEQ ID NO: 4148 - protein, 18 aa, synthetic construct
KTINGSGSPHSKAQLQRT

SEQ ID NO: 4149 - protein, 18 aa, synthetic construct
KTINGSGSPHSKAQNARR

SEQ ID NO: 4150 - protein, 18 aa, synthetic construct
KTINGSGSPHSKAQNCPR

SEQ ID NO: 4151 - protein, 18 aa, synthetic construct
KTINGSGSPHSKAQNMRR

SEQ ID NO: 4152 - protein, 18 aa, synthetic construct
KTINGSGSPHSKAQNRRV

SEQ ID NO: 4153 - protein, 18 aa, synthetic construct
KTINGSGSPHSKAQPSRT

SEQ ID NO: 4154 - protein, 18 aa, synthetic construct
KTINGSGSPHSKAQQVKT

SEQ ID NO: 4155 - protein, 18 aa, synthetic construct
KTINGSGSPHSKAQQVRT

SEQ ID NO: 4156 - protein, 18 aa, synthetic construct
KTINGSGSPHSKAQRLKT

SEQ ID NO: 4157 - protein, 18 aa, synthetic construct
KTINGSGSPHSKAQRRAT

SEQ ID NO: 4158 - protein, 18 aa, synthetic construct
KTINGSGSPHSKAQRRGT

SEQ ID NO: 4159 - protein, 18 aa, synthetic construct
KTINGSGSPHSKAQRRRT

SEQ ID NO: 4160 - protein, 18 aa, synthetic construct
KTINGSGSPHSKAQRTRT

SEQ ID NO: 4161 - protein, 18 aa, synthetic construct
KTINGSGSPHSKAQRVHT

SEQ ID NO: 4162 - protein, 18 aa, synthetic construct
KTINGSGSPHSKAQTYRT

SEQ ID NO: 4163 - protein, 18 aa, synthetic construct
KTINGSGSPHSKAQVRKT

SEQ ID NO: 4164 - protein, 18 aa, synthetic construct
KTINGSGSPHSKARGRQT

SEQ ID NO: 4165 - protein, 18 aa, synthetic construct
KTINGSGSPHSKARLCQT

SEQ ID NO: 4166 - protein, 18 aa, synthetic construct
KTINGSGSPHSKARLKQT

SEQ ID NO: 4167 - protein, 18 aa, synthetic construct
KTINGSGSPHSKARNSQT

SEQ ID NO: 4168 - protein, 18 aa, synthetic construct
KTINGSGSPHSKARWVQT

SEQ ID NO: 4169 - protein, 18 aa, synthetic construct
KTINGSGSPHSKAVRWQT

SEQ ID NO: 4170 - protein, 18 aa, synthetic construct
KTINGSGSPHSKAYTRQT

SEQ ID NO: 4171 - protein, 18 aa, synthetic construct
KTINGSGSPHSKCQSQQT

SEQ ID NO: 4172 - protein, 18 aa, synthetic construct
KTINGSGSPHSKFLRQQT

SEQ ID NO: 4173 - protein, 18 aa, synthetic construct
KTINGSGSPHSKFRFQQT

SEQ ID NO: 4174 - protein, 18 aa, synthetic construct
KTINGSGSPHSKFRLQQT

SEQ ID NO: 4175 - protein, 18 aa, synthetic construct
KTINGSGSPHSKFRRQQT

SEQ ID NO: 4176 - protein, 18 aa, synthetic construct
KTINGSGSPHSKGMKQQT

SEQ ID NO: 4177 - protein, 18 aa, synthetic construct
KTINGSGSPHSKKLRQQT

SEQ ID NO: 4178 - protein, 18 aa, synthetic construct
KTINGSGSPHSKKRPQQT

SEQ ID NO: 4179 - protein, 18 aa, synthetic construct
KTINGSGSPHSKKSRQQT

SEQ ID NO: 4180 - protein, 18 aa, synthetic construct
KTINGSGSPHSKLYRQQT

SEQ ID NO: 4181 - protein, 18 aa, synthetic construct
KTINGSGSPHSKLYWQQT

SEQ ID NO: 4182 - protein, 18 aa, synthetic construct
KTINGSGSPHSKPRMQQT

SEQ ID NO: 4183 - protein, 18 aa, synthetic construct
KTINGSGSPHSKRFPQQT

SEQ ID NO: 4184 - protein, 18 aa, synthetic construct
KTINGSGSPHSKRFRQQT

SEQ ID NO: 4185 - protein, 18 aa, synthetic construct
KTINGSGSPHSKRPYQQT

SEQ ID NO: 4186 - protein, 18 aa, synthetic construct
KTINGSGSPHSKRRMQQT

SEQ ID NO: 4187 - protein, 18 aa, synthetic construct
KTINGSGSPHSKRSKQQT

SEQ ID NO: 4188 - protein, 18 aa, synthetic construct
KTINGSGSPHSKRSRQQT

SEQ ID NO: 4189 - protein, 18 aa, synthetic construct
KTINGSGSPHSKRTMQQT

SEQ ID NO: 4190 - protein, 18 aa, synthetic construct
KTINGSGSPHSKRTRQQT

SEQ ID NO: 4191 - protein, 18 aa, synthetic construct
KTINGSGSPHSKRVRQQT

SEQ ID NO: 4192 - protein, 18 aa, synthetic construct
KTINGSGSPHSKRYIQQT

SEQ ID NO: 4193 - protein, 18 aa, synthetic construct
KTINGSGSPHSKRYNQQT

SEQ ID NO: 4194 - protein, 18 aa, synthetic construct
KTINGSGSPHSKRYPQQT

SEQ ID NO: 4195 - protein, 18 aa, synthetic construct
KTINGSGSPHSKRYSQQT

SEQ ID NO: 4196 - protein, 18 aa, synthetic construct
KTINGSGSPHSKTCIQQT

SEQ ID NO: 4197 - protein, 18 aa, synthetic construct
KTINGSGSPHSKWLTQQT

SEQ ID NO: 4198 - protein, 18 aa, synthetic construct
KTINGSGSPHSKWVVQQT

SEQ ID NO: 4199 - protein, 18 aa, synthetic construct
KTINGSGSPHSKYRLQQT

SEQ ID NO: 4200 - protein, 18 aa, synthetic construct
KTINGSGSPHSKYSKQQT

SEQ ID NO: 4201 - protein, 18 aa, synthetic construct
KTINGSGSPHSKYSRQQT

SEQ ID NO: 4202 - protein, 18 aa, synthetic construct
KTINGSGSPHSLKRNQQT

SEQ ID NO: 4203 - protein, 18 aa, synthetic construct
KTINGSGSPHSLWFNQQT

SEQ ID NO: 4204 - protein, 18 aa, synthetic construct
KTINGSGSPHSLWPNQQT

SEQ ID NO: 4205 - protein, 18 aa, synthetic construct
KTINGSGSPHSLWTNQQT

SEQ ID NO: 4206 - protein, 18 aa, synthetic construct
KTINGSGSPHSMRRNQQT

SEQ ID NO: 4207 - protein, 18 aa, synthetic construct
KTINGSGSPHSPCLNQQT

SEQ ID NO: 4208 - protein, 18 aa, synthetic construct
KTINGSGSPHSQWQNQQT

SEQ ID NO: 4209 - protein, 18 aa, synthetic construct
KTINGSGSPHSRCANQQT

SEQ ID NO: 4210 - protein, 18 aa, synthetic construct
KTINGSGSPHSRIRNQQT

SEQ ID NO: 4211 - protein, 18 aa, synthetic construct
KTINGSGSPHSRKSNQQT

SEQ ID NO: 4212 - protein, 18 aa, synthetic construct
KTINGSGSPHSRLWNQQT

SEQ ID NO: 4213 - protein, 18 aa, synthetic construct
KTINGSGSPHSRRFNQQT

SEQ ID NO: 4214 - protein, 18 aa, synthetic construct
KTINGSGSPHSRRPNQQT

SEQ ID NO: 4215 - protein, 18 aa, synthetic construct
KTINGSGSPHSRSCNQQT

SEQ ID NO: 4216 - protein, 18 aa, synthetic construct
KTINGSGSPHSRSKNQQT

SEQ ID NO: 4217 - protein, 18 aa, synthetic construct
KTINGSGSPHSRTKNQQT

SEQ ID NO: 4218 - protein, 18 aa, synthetic construct
KTINGSGSPHSRWLNQQT

SEQ ID NO: 4219 - protein, 18 aa, synthetic construct
KTINGSGSPHSSVCNQQT

SEQ ID NO: 4220 - protein, 18 aa, synthetic construct
KTINGSGSPHSSWRNQQT

SEQ ID NO: 4221 - protein, 18 aa, synthetic construct
KTINGSGSPHSVCQNQQT

SEQ ID NO: 4222 - protein, 18 aa, synthetic construct
KTINGSGSPHSVLCNQQT

SEQ ID NO: 4223 - protein, 18 aa, synthetic construct
KTINGSGSPHSVRRNQQT

SEQ ID NO: 4224 - protein, 18 aa, synthetic construct
KTINGSGSPHSVSCNQQT

SEQ ID NO: 4225 - protein, 18 aa, synthetic construct
KTINGSGSPHSWALNQQT

SEQ ID NO: 4226 - protein, 18 aa, synthetic construct
KTINGSGSPHSWITNQQT

SEQ ID NO: 4227 - protein, 18 aa, synthetic construct
KTINGSGSPHSWPMNQQT

SEQ ID NO: 4228 - protein, 18 aa, synthetic construct
KTINGSGSPHSWRSNQQT

SEQ ID NO: 4229 - protein, 18 aa, synthetic construct
KTINGSGSPHSYFLNQQT

SEQ ID NO: 4230 - protein, 18 aa, synthetic construct
KTINGSGSPHSYTYNQQT

SEQ ID NO: 4231 - protein, 18 aa, synthetic construct
KTINGSGSPHSYWQNQQT

SEQ ID NO: 4232 - protein, 18 aa, synthetic construct
KTINGSGSPHTLCQNQQT

SEQ ID NO: 4233 - protein, 18 aa, synthetic construct
KTINGSGSPHWLRQNQQT

SEQ ID NO: 4234 - protein, 18 aa, synthetic construct
KTINGSGSPHWPSQNQQT

SEQ ID NO: 4235 - protein, 18 aa, synthetic construct
KTINGSGSPHYLRQNQQT

SEQ ID NO: 4236 - protein, 18 aa, synthetic construct
KTINGSGSPHYTRQNQQT

SEQ ID NO: 4237 - protein, 18 aa, synthetic construct
KTINGSLSPHLWAQNQQT

SEQ ID NO: 4238 - protein, 18 aa, synthetic construct
KTINGSPSPHCQAQNQQT

SEQ ID NO: 4239 - protein, 18 aa, synthetic construct
KTINGSRSPHLCAQNQQT

SEQ ID NO: 4240 - protein, 18 aa, synthetic construct
KTINGSRSPHWRAQNQQT

SEQ ID NO: 4241 - protein, 18 aa, synthetic construct
KTINGSVSPHWLAQNQQT

SEQ ID NO: 4242 - protein, 18 aa, synthetic construct
KTINGTFSPHRKAQNQQT

SEQ ID NO: 4243 - protein, 18 aa, synthetic construct
KTINGWTSPHRKAQNQQT

SEQ ID NO: 4244 - protein, 18 aa, synthetic construct
KTINRGISPHSKAQNQQT

SEQ ID NO: 4245 - protein, 18 aa, synthetic construct
KTINTVRSPHSKAQNQQT

SEQ ID NO: 4246 - protein, 18 aa, synthetic construct
KTKLRSGSPHSKAQNQQT

SEQ ID NO: 4247 - protein, 18 aa, synthetic construct
KTRLRSGSPHSKAQNQQT

SEQ ID NO: 4248 - protein, 18 aa, synthetic construct
KWLLGSGSPHSKAQNQQT

SEQ ID NO: 4249 - protein, 18 aa, synthetic construct
KWSQGSGSPHSKAQNQQT

SEQ ID NO: 4250 - protein, 18 aa, synthetic construct
KWYLGSGSPHSKAQNQQT

SEQ ID NO: 4251 - protein, 18 aa, synthetic construct
KYHSGSGSPHSKAQNQQT

SEQ ID NO: 4252 - protein, 18 aa, synthetic construct
KYLPGSGSPHSKAQNQQT

SEQ ID NO: 4253 - protein, 18 aa, synthetic construct
KAINGGGSPHSKTQNQQT

SEQ ID NO: 4254 - protein, 18 aa, synthetic construct
KAINGHDSPHKRSPNQQT

SEQ ID NO: 4255 - protein, 18 aa, synthetic construct
KAINGHDSPHKSFSPQQT

SEQ ID NO: 4256 - protein, 18 aa, synthetic construct
KAINGHDSPHKSGENQQP

SEQ ID NO: 4257 - protein, 18 aa, synthetic construct
KAINGHDSPHKSGQLART

SEQ ID NO: 4258 - protein, 18 aa, synthetic construct
KAINGHDSPHKSGQNAFL

SEQ ID NO: 4259 - protein, 18 aa, synthetic construct
KAINGHDSPHKSGQNAYT

SEQ ID NO: 4260 - protein, 18 aa, synthetic construct
KAINGHDSPHKSGQNFAS

SEQ ID NO: 4261 - protein, 18 aa, synthetic construct
KAINGHDSPHKSGQNLAS

SEQ ID NO: 4262 - protein, 18 aa, synthetic construct
KAINGHDSPHKSGQNLGS

SEQ ID NO: 4263 - protein, 18 aa, synthetic construct
KAINGHDSPHKSGQNLKF

SEQ ID NO: 4264 - protein, 18 aa, synthetic construct
KAINGHDSPHKSGQNLLK

SEQ ID NO: 4265 - protein, 18 aa, synthetic construct
KAINGHDSPHKSGQNLSR

SEQ ID NO: 4266 - protein, 18 aa, synthetic construct
KAINGHDSPHKSGQNLSS

SEQ ID NO: 4267 - protein, 18 aa, synthetic construct
KAINGHDSPHKSGQNSLG

SEQ ID NO: 4268 - protein, 18 aa, synthetic construct
KAINGHDSPHKSGQNTLQ

SEQ ID NO: 4269 - protein, 18 aa, synthetic construct
KAINGHDSPHKSGQNTSL

SEQ ID NO: 4270 - protein, 18 aa, synthetic construct
KAINGHDSPHKSGQRLGT

SEQ ID NO: 4271 - protein, 18 aa, synthetic construct
KAINGHDSPHKSGQRNYT

SEQ ID NO: 4272 - protein, 18 aa, synthetic construct
KAINGHDSPHKSGQRPST

SEQ ID NO: 4273 - protein, 18 aa, synthetic construct
KAINGHDSPHKSGQRPVT

SEQ ID NO: 4274 - protein, 18 aa, synthetic construct
KAINGHDSPHKSGQVPST

SEQ ID NO: 4275 - protein, 18 aa, synthetic construct
KAINGHDSPHKSLSNQQT

SEQ ID NO: 4276 - protein, 18 aa, synthetic construct
KAINGHDSPHKSVLSQQT

SEQ ID NO: 4277 - protein, 18 aa, synthetic construct
KAINGHDSPHKTLQNQQT

SEQ ID NO: 4278 - protein, 18 aa, synthetic construct
KAINGHNSPHSKAQNQQT

SEQ ID NO: 4279 - protein, 18 aa, synthetic construct
KAINGLDSPHSKAQNQQT

SEQ ID NO: 4280 - protein, 18 aa, synthetic construct
KAINGSGSPHKSGQNQQT

SEQ ID NO: 4281 - protein, 18 aa, synthetic construct
KAINGSGSPHSKAQGQQT

SEQ ID NO: 4282 - protein, 18 aa, synthetic construct
KAINGSGSPHSKAQLSGT

SEQ ID NO: 4283 - protein, 18 aa, synthetic construct
KAINGSGSPHSKAQNGSL

SEQ ID NO: 4284 - protein, 18 aa, synthetic construct
KAINGSGSPHSKAQNSLL

SEQ ID NO: 4285 - protein, 18 aa, synthetic construct
KAINGSGSPHSKAVGLQT

SEQ ID NO: 4286 - protein, 18 aa, synthetic construct
KAINGSGSPHSKSLLQQT

SEQ ID NO: 4287 - protein, 18 aa, synthetic construct
KAINGSGSPHSKSLPQQT

SEQ ID NO: 4288 - protein, 18 aa, synthetic construct
KAINGSGSPHSKSTFQQT

SEQ ID NO: 4289 - protein, 18 aa, synthetic construct
KAITGHDSPHSKAQNQQT

SEQ ID NO: 4290 - protein, 18 aa, synthetic construct
KDVMGSGSPHSKAQNQQT

SEQ ID NO: 4291 - protein, 18 aa, synthetic construct
KEIVGSGSPHSKAQNQQT

SEQ ID NO: 4292 - protein, 18 aa, synthetic construct
KEIYGSGSPHSKAQNQQT

SEQ ID NO: 4293 - protein, 18 aa, synthetic construct
KELSGSGSPHSKAQNQQT

SEQ ID NO: 4294 - protein, 18 aa, synthetic construct
KETIGSGSPHSKAQNQQT

SEQ ID NO: 4295 - protein, 18 aa, synthetic construct
KEVLGSGSPHSKAQNQQT

SEQ ID NO: 4296 - protein, 18 aa, synthetic construct
KFALGHDSPHKSGQKQQT

SEQ ID NO: 4297 - protein, 18 aa, synthetic construct
KIINGHDSPHKSGQNLVL

SEQ ID NO: 4298 - protein, 18 aa, synthetic construct
KIINGHDSPHKSGQRNYT

SEQ ID NO: 4299 - protein, 18 aa, synthetic construct
KIINGHDSPHSKAQNQQT

SEQ ID NO: 4300 - protein, 18 aa, synthetic construct
KLNPGHDSPHKSGQTQQT

SEQ ID NO: 4301 - protein, 18 aa, synthetic construct
KLNRGHDSPHKSGQNQQS

SEQ ID NO: 4302 - protein, 18 aa, synthetic construct
KLSSGHDSPHKSGQNQQN

SEQ ID NO: 4303 - protein, 18 aa, synthetic construct
KNINGHDSPHSKAQNQQT

SEQ ID NO: 4304 - protein, 18 aa, synthetic construct
KNNDGSGSPHSKAQNQQT

SEQ ID NO: 4305 - protein, 18 aa, synthetic construct
KNVMGSGSPHSKAQNQQT

SEQ ID NO: 4306 - protein, 18 aa, synthetic construct
KPINGHDSPHKSGQNKLS

SEQ ID NO: 4307 - protein, 18 aa, synthetic construct
KPINGHDSPHKSGQNLSS

SEQ ID NO: 4308 - protein, 18 aa, synthetic construct
KPINGHDSPHSKAQNQQT

SEQ ID NO: 4309 - protein, 18 aa, synthetic construct
KRINGHDSPHSKAQNQQT

SEQ ID NO: 4310 - protein, 18 aa, synthetic construct
KSCSGHDSPHKSGQNQQS

SEQ ID NO: 4311 - protein, 18 aa, synthetic construct
KSINGHDSPHKSGQNLAS

SEQ ID NO: 4312 - protein, 18 aa, synthetic construct
KSINGHDSPHKSGQNLFL

SEQ ID NO: 4313 - protein, 18 aa, synthetic construct
KSINGHDSPHKSGQNLLM

SEQ ID NO: 4314 - protein, 18 aa, synthetic construct
KSINGHDSPHKSGQNLLQ

SEQ ID NO: 4315 - protein, 18 aa, synthetic construct
KSINGHDSPHKSGQNSLG

SEQ ID NO: 4316 - protein, 18 aa, synthetic construct
KSINGHDSPHKSGQNTLQ

SEQ ID NO: 4317 - protein, 18 aa, synthetic construct
KSINGHDSPHKSSSNQQT

SEQ ID NO: 4318 - protein, 18 aa, synthetic construct
KSINGHDSPHKYKLNQQT

SEQ ID NO: 4319 - protein, 18 aa, synthetic construct
KSINGSGSPHKSGQKQQT

SEQ ID NO: 4320 - protein, 18 aa, synthetic construct
KSINGSGSPHKSGQNQQT

SEQ ID NO: 4321 - protein, 18 aa, synthetic construct
KSINGSGSPHSKAQGLST

SEQ ID NO: 4322 - protein, 18 aa, synthetic construct
KSINGSGSPHSKAQLLGT

SEQ ID NO: 4323 - protein, 18 aa, synthetic construct
KSINGSGSPHSKTSWQQT

SEQ ID NO: 4324 - protein, 18 aa, synthetic construct
KSMNGHDSPHSKAQNQQT

SEQ ID NO: 4325 - protein, 18 aa, synthetic construct
KSTLGSGSPHSKAQNQHT

SEQ ID NO: 4326 - protein, 18 aa, synthetic construct
KSTLGSGSPHSKAQNQQN

SEQ ID NO: 4327 - protein, 18 aa, synthetic construct
KSTVGSGSPHSKAQTQQT

SEQ ID NO: 4328 - protein, 18 aa, synthetic construct
KTCKESGSPHSKAQNQQT

SEQ ID NO: 4329 - protein, 18 aa, synthetic construct
KTCKGSGSPHSKAQNQQT

SEQ ID NO: 4330 - protein, 18 aa, synthetic construct
KTCKSSGSPHSKAQNQQT

SEQ ID NO: 4331 - protein, 18 aa, synthetic construct
KTDMGSGSPHSKAQNQQT

SEQ ID NO: 4332 - protein, 18 aa, synthetic construct
KTDNGIGSPHSKAQNQQT

SEQ ID NO: 4333 - protein, 18 aa, synthetic construct
KTEGGSGSPHSKAQNQQT

SEQ ID NO: 4334 - protein, 18 aa, synthetic construct
KTEHHSGSPHSKAQNQQT

SEQ ID NO: 4335 - protein, 18 aa, synthetic construct
KTEKDSGSPHSKAQNQQT

SEQ ID NO: 4336 - protein, 18 aa, synthetic construct
KTELGHDSPHKRGQNQQT

SEQ ID NO: 4337 - protein, 18 aa, synthetic construct
KTESVSGSPHSKAQNQQT

SEQ ID NO: 4338 - protein, 18 aa, synthetic construct
KTETNSGSPHSKAQNQQT

SEQ ID NO: 4339 - protein, 18 aa, synthetic construct
KTETYSGSPHSKAQNQQT

SEQ ID NO: 4340 - protein, 18 aa, synthetic construct
KTEWLSGSPHSKAQNQQT

SEQ ID NO: 4341 - protein, 18 aa, synthetic construct
KTFNGSGSPHKSGQNQQT

SEQ ID NO: 4342 - protein, 18 aa, synthetic construct
KTGLRHDSPHKSGQKQQT

SEQ ID NO: 4343 - protein, 18 aa, synthetic construct
KTGLRHDSPHKSGQNQQS

SEQ ID NO: 4344 - protein, 18 aa, synthetic construct
KTGVTHDSPHKSGQKQQT

SEQ ID NO: 4345 - protein, 18 aa, synthetic construct
KTIDGHESPHSKAQNQQT

SEQ ID NO: 4346 - protein, 18 aa, synthetic construct
KTIEGHDSPHKSGQTQQT

SEQ ID NO: 4347 - protein, 18 aa, synthetic construct
KTIHGHDSPHSKAQNQQT

SEQ ID NO: 4348 - protein, 18 aa, synthetic construct
KTIHGHESPHSKAQNQQT

SEQ ID NO: 4349 - protein, 18 aa, synthetic construct
KTIIGHDSPHKSGQNRSS

SEQ ID NO: 4350 - protein, 18 aa, synthetic construct
KTIIGHDSPHKSGQRLGT

SEQ ID NO: 4351 - protein, 18 aa, synthetic construct
KTIIGSGSPHKSGQNQQT

SEQ ID NO: 4352 - protein, 18 aa, synthetic construct
KTIKGHDSPHKSGQNMLF

SEQ ID NO: 4353 - protein, 18 aa, synthetic construct
KTILGSGSPHSKAQNLQT

SEQ ID NO: 4354 - protein, 18 aa, synthetic construct
KTINGCSSPHWKAQNQQT

SEQ ID NO: 4355 - protein, 18 aa, synthetic construct
KTINGGGSTHSKAQNQQT

SEQ ID NO: 4356 - protein, 18 aa, synthetic construct
KTINGHDSPHKAGQSQQT

SEQ ID NO: 4357 - protein, 18 aa, synthetic construct
KTINGHDSPHKRGQNVPS

SEQ ID NO: 4358 - protein, 18 aa, synthetic construct
KTINGHDSPHKRGRSYQT

SEQ ID NO: 4359 - protein, 18 aa, synthetic construct
KTINGHDSPHKTGQNPPT

SEQ ID NO: 4360 - protein, 18 aa, synthetic construct
KTINGHDSPHSKAENQQT

SEQ ID NO: 4361 - protein, 18 aa, synthetic construct
KTINGHDSPHSKALSLQT

SEQ ID NO: 4362 - protein, 18 aa, synthetic construct
KTINGHDSPHSKAQGQQT

SEQ ID NO: 4363 - protein, 18 aa, synthetic construct
KTINGHDSPHSKAQHQQT

SEQ ID NO: 4364 - protein, 18 aa, synthetic construct
KTINGHDSPHSKAQIQQT

SEQ ID NO: 4365 - protein, 18 aa, synthetic construct
KTINGHDSPHSKAQKQQT

SEQ ID NO: 4366 - protein, 18 aa, synthetic construct
KTINGHDSPHSKAQNLSS

SEQ ID NO: 4367 - protein, 18 aa, synthetic construct
KTINGHDSPHSKAQNPQT

SEQ ID NO: 4368 - protein, 18 aa, synthetic construct
KTINGHDSPHSKAQNQET

SEQ ID NO: 4369 - protein, 18 aa, synthetic construct
KTINGHDSPHSKAQNQHT

SEQ ID NO: 4370 - protein, 18 aa, synthetic construct
KTINGHDSPHSKAQNQLT

SEQ ID NO: 4371 - protein, 18 aa, synthetic construct
KTINGHDSPHSKAQNQPT

SEQ ID NO: 4372 - protein, 18 aa, synthetic construct
KTINGHDSPHSKAQNQQA

SEQ ID NO: 4373 - protein, 18 aa, synthetic construct
KTINGHDSPHSKAQNTGS

SEQ ID NO: 4374 - protein, 18 aa, synthetic construct
KTINGHDSPHSKAQSQQT

SEQ ID NO: 4375 - protein, 18 aa, synthetic construct
KTINGHDSPHSKAQTQQT

SEQ ID NO: 4376 - protein, 18 aa, synthetic construct
KTINGHDSPHSKAQYQQT

SEQ ID NO: 4377 - protein, 18 aa, synthetic construct
KTINGHDSPHSKARNQQT

SEQ ID NO: 4378 - protein, 18 aa, synthetic construct
KTINGHDSPHSKLPGQQT

SEQ ID NO: 4379 - protein, 18 aa, synthetic construct
KTINGHDSPHSKSPNQQT

SEQ ID NO: 4380 - protein, 18 aa, synthetic construct
KTINGHESPHKSGQNAFL

SEQ ID NO: 4381 - protein, 18 aa, synthetic construct
KTINGIGSPHSKAPNEQT

SEQ ID NO: 4382 - protein, 18 aa, synthetic construct
KTINGQDSPHKSGQNLHM

SEQ ID NO: 4383 - protein, 18 aa, synthetic construct
KTINGRGSPHSKAQIGMT

SEQ ID NO: 4384 - protein, 18 aa, synthetic construct
KTINGRGSPHSKAQNQVL

SEQ ID NO: 4385 - protein, 18 aa, synthetic construct
KTINGRGSPHSKAQSPTT

SEQ ID NO: 4386 - protein, 18 aa, synthetic construct
KTINGRGSPHSKATSFQT

SEQ ID NO: 4387 - protein, 18 aa, synthetic construct
KTINGSGSPHFVVQNQQT

SEQ ID NO: 4388 - protein, 18 aa, synthetic construct
KTINGSGSPHKRGQKQQT

SEQ ID NO: 4389 - protein, 18 aa, synthetic construct
KTINGSGSPHKRGQNQET

SEQ ID NO: 4390 - protein, 18 aa, synthetic construct
KTINGSGSPHKRGQNQLT

SEQ ID NO: 4391 - protein, 18 aa, synthetic construct
KTINGSGSPHKRGRNQQT

SEQ ID NO: 4392 - protein, 18 aa, synthetic construct
KTINGSGSPHKSGGNQQT

SEQ ID NO: 4393 - protein, 18 aa, synthetic construct
KTINGSGSPHKSGHNQET

SEQ ID NO: 4394 - protein, 18 aa, synthetic construct
KTINGSGSPHKSGHNQLT

SEQ ID NO: 4395 - protein, 18 aa, synthetic construct
KTINGSGSPHKSGHNQQN

SEQ ID NO: 4396 - protein, 18 aa, synthetic construct
KTINGSGSPHKSGLNQLT

SEQ ID NO: 4397 - protein, 18 aa, synthetic construct
KTINGSGSPHKSGPNQQT

SEQ ID NO: 4398 - protein, 18 aa, synthetic construct
KTINGSGSPHKSGQGQQT

SEQ ID NO: 4399 - protein, 18 aa, synthetic construct
KTINGSGSPHKSGQHLQT

SEQ ID NO: 4400 - protein, 18 aa, synthetic construct
KTINGSGSPHKSGQHQQT

SEQ ID NO: 4401 - protein, 18 aa, synthetic construct
KTINGSGSPHKSGQKHQT

SEQ ID NO: 4402 - protein, 18 aa, synthetic construct
KTINGSGSPHKSGQKQQS

SEQ ID NO: 4403 - protein, 18 aa, synthetic construct
KTINGSGSPHKSGQNEQT

SEQ ID NO: 4404 - protein, 18 aa, synthetic construct
KTINGSGSPHKSGQNHQT

SEQ ID NO: 4405 - protein, 18 aa, synthetic construct
KTINGSGSPHKSGQNKQT

SEQ ID NO: 4406 - protein, 18 aa, synthetic construct
KTINGSGSPHKSGQNKTS

SEQ ID NO: 4407 - protein, 18 aa, synthetic construct
KTINGSGSPHKSGQNQEA

SEQ ID NO: 4408 - protein, 18 aa, synthetic construct
KTINGSGSPHKSGQNQET

SEQ ID NO: 4409 - protein, 18 aa, synthetic construct
KTINGSGSPHKSGQNQKT

SEQ ID NO: 4410 - protein, 18 aa, synthetic construct
KTINGSGSPHKSGQNQQI

SEQ ID NO: 4411 - protein, 18 aa, synthetic construct
KTINGSGSPHKSGQNQQR

SEQ ID NO: 4412 - protein, 18 aa, synthetic construct
KTINGSGSPHKSGQNQRT

SEQ ID NO: 4413 - protein, 18 aa, synthetic construct
KTINGSGSPHKSGQNQYT

SEQ ID NO: 4414 - protein, 18 aa, synthetic construct
KTINGSGSPHKSGQRQQT

SEQ ID NO: 4415 - protein, 18 aa, synthetic construct
KTINGSGSPHKSGQSQQT

SEQ ID NO: 4416 - protein, 18 aa, synthetic construct
KTINGSGSPHKSGQYQRT

SEQ ID NO: 4417 - protein, 18 aa, synthetic construct
KTINGSGSPHKSGRNQQA

SEQ ID NO: 4418 - protein, 18 aa, synthetic construct
KTINGSGSPHKSRHNQQT

SEQ ID NO: 4419 - protein, 18 aa, synthetic construct
KTINGSGSPHKSRQYQQT

SEQ ID NO: 4420 - protein, 18 aa, synthetic construct
KTINGSGSPHRKAQAPGT

SEQ ID NO: 4421 - protein, 18 aa, synthetic construct
KTINGSGSPHSKAAMKQT

SEQ ID NO: 4422 - protein, 18 aa, synthetic construct
KTINGSGSPHSKAGRQQT

SEQ ID NO: 4423 - protein, 18 aa, synthetic construct
KTINGSGSPHSKAGRTQT

SEQ ID NO: 4424 - protein, 18 aa, synthetic construct
KTINGSGSPHSKAKSNQT

SEQ ID NO: 4425 - protein, 18 aa, synthetic construct
KTINGSGSPHSKALKTQT

SEQ ID NO: 4426 - protein, 18 aa, synthetic construct
KTINGSGSPHSKAPRTQT

SEQ ID NO: 4427 - protein, 18 aa, synthetic construct
KTINGSGSPHSKAQAART

SEQ ID NO: 4428 - protein, 18 aa, synthetic construct
KTINGSGSPHSKAQAILT

SEQ ID NO: 4429 - protein, 18 aa, synthetic construct
KTINGSGSPHSKAQCRGT

SEQ ID NO: 4430 - protein, 18 aa, synthetic construct
KTINGSGSPHSKAQGLRT

SEQ ID NO: 4431 - protein, 18 aa, synthetic construct
KTINGSGSPHSKAQKGVL

SEQ ID NO: 4432 - protein, 18 aa, synthetic construct
KTINGSGSPHSKAQKSNT

SEQ ID NO: 4433 - protein, 18 aa, synthetic construct
KTINGSGSPHSKAQNNKF

SEQ ID NO: 4434 - protein, 18 aa, synthetic construct
KTINGSGSPHSKAQNRRT

SEQ ID NO: 4435 - protein, 18 aa, synthetic construct
KTINGSGSPHSKAQPKQT

SEQ ID NO: 4436 - protein, 18 aa, synthetic construct
KTINGSGSPHSKAQRAPT

SEQ ID NO: 4437 - protein, 18 aa, synthetic construct
KTINGSGSPHSKAQREHT

SEQ ID NO: 4438 - protein, 18 aa, synthetic construct
KTINGSGSPHSKAQRFGT

SEQ ID NO: 4439 - protein, 18 aa, synthetic construct
KTINGSGSPHSKAQRPCT

SEQ ID NO: 4440 - protein, 18 aa, synthetic construct
KTINGSGSPHSKAQRQAT

SEQ ID NO: 4441 - protein, 18 aa, synthetic construct
KTINGSGSPHSKAQRQPT

SEQ ID NO: 4442 - protein, 18 aa, synthetic construct
KTINGSGSPHSKAQTKLT

SEQ ID NO: 4443 - protein, 18 aa, synthetic construct
KTINGSGSPHSKAQTTHT

SEQ ID NO: 4444 - protein, 18 aa, synthetic construct
KTINGSGSPHSKAQVQRT

SEQ ID NO: 4445 - protein, 18 aa, synthetic construct
KTINGSGSPHSKAQVVRT

SEQ ID NO: 4446 - protein, 18 aa, synthetic construct
KTINGSGSPHSKAQWPNT

SEQ ID NO: 4447 - protein, 18 aa, synthetic construct
KTINGSGSPHSKAQYPST

SEQ ID NO: 4448 - protein, 18 aa, synthetic construct
KTINGSGSPHSKARALQT

SEQ ID NO: 4449 - protein, 18 aa, synthetic construct
KTINGSGSPHSKARDQHT

SEQ ID NO: 4450 - protein, 18 aa, synthetic construct
KTINGSGSPHSKARFQQT

SEQ ID NO: 4451 - protein, 18 aa, synthetic construct
KTINGSGSPHSKARRTQT

SEQ ID NO: 4452 - protein, 18 aa, synthetic construct
KTINGSGSPHSKARSLQT

SEQ ID NO: 4453 - protein, 18 aa, synthetic construct
KTINGSGSPHSKARVIQT

SEQ ID NO: 4454 - protein, 18 aa, synthetic construct
KTINGSGSPHSKAWYLQT

SEQ ID NO: 4455 - protein, 18 aa, synthetic construct
KTINGSGSPHSKGGGQQT

SEQ ID NO: 4456 - protein, 18 aa, synthetic construct
KTINGSGSPHSKGSRQQT

SEQ ID NO: 4457 - protein, 18 aa, synthetic construct
KTINGSGSPHSKLQRQQT

SEQ ID NO: 4458 - protein, 18 aa, synthetic construct
KTINGSGSPHSKMLRQQT

SEQ ID NO: 4459 - protein, 18 aa, synthetic construct
KTINGSGSPHSKSSIKQT

SEQ ID NO: 4460 - protein, 18 aa, synthetic construct
KTINGSGSPHSKVRFQQT

SEQ ID NO: 4461 - protein, 18 aa, synthetic construct
KTINGSGSPHSVVWNQQT

SEQ ID NO: 4462 - protein, 18 aa, synthetic construct
KTINGSTSPHKLAQNQQP

SEQ ID NO: 4463 - protein, 18 aa, synthetic construct
KTINRHDSPHKSGQRPST

SEQ ID NO: 4464 - protein, 18 aa, synthetic construct
KTINRIMSPHSKAQNQQT

SEQ ID NO: 4465 - protein, 18 aa, synthetic construct
KTINTARSPHSKAQNQQT

SEQ ID NO: 4466 - protein, 18 aa, synthetic construct
KTISGHDSPHSKAQNQQT

SEQ ID NO: 4467 - protein, 18 aa, synthetic construct
KTISGSGSPHKSGQNQQT

SEQ ID NO: 4468 - protein, 18 aa, synthetic construct
KTITGHDSPHKSGQRLGT

SEQ ID NO: 4469 - protein, 18 aa, synthetic construct
KTITGSGSPHKSGQNQQT

SEQ ID NO: 4470 - protein, 18 aa, synthetic construct
KTIYGHDSPHKSGQRLGT

SEQ ID NO: 4471 - protein, 18 aa, synthetic construct
KTLNGHDSPHKSGQNLFL

SEQ ID NO: 4472 - protein, 18 aa, synthetic construct
KTLNGHDSPHKSGQNLSS

SEQ ID NO: 4473 - protein, 18 aa, synthetic construct
KTLSFHDSPHKSGQNQQS

SEQ ID NO: 4474 - protein, 18 aa, synthetic construct
KTSNGSGSPHSKAQNTMT

SEQ ID NO: 4475 - protein, 18 aa, synthetic construct
KTTNGHDSPHSKAQNQQT

SEQ ID NO: 4476 - protein, 18 aa, synthetic construct
KTVNGGGSPHSKAQNQQT

SEQ ID NO: 4477 - protein, 18 aa, synthetic construct
KTVNGHDSPHKSGQNVSL

SEQ ID NO: 4478 - protein, 18 aa, synthetic construct
KTVNGHDSPHKSGQRPST

SEQ ID NO: 4479 - protein, 18 aa, synthetic construct
KTVNGHDSPHKSGQTQQA

SEQ ID NO: 4480 - protein, 18 aa, synthetic construct
KTVNGHESPHSKAQNQQT

SEQ ID NO: 4481 - protein, 18 aa, synthetic construct
KTVNGSGSPHSKAQGLST

SEQ ID NO: 4482 - protein, 18 aa, synthetic construct
KTVNGSGSPHSKAQNVTS

SEQ ID NO: 4483 - protein, 18 aa, synthetic construct
KTVPASGSPHSKAQNQQT

SEQ ID NO: 4484 - protein, 18 aa, synthetic construct
NTINGSGSPHSKAHNQQT

SEQ ID NO: 4485 - protein, 18 aa, synthetic construct
TTINGGGSPHSKAQNQQT

SEQ ID NO: 4486 - protein, 8 aa, synthetic construct
HDSPHSKA

SEQ ID NO: 4487 - protein, 9 aa, synthetic construct
NGSGQNQQT

SEQ ID NO: 4488-4672 - skipped (185 entries)

SEQ ID NO: 4673 - DNA, 23 bp, synthetic construct
  source 1..23: mol_type = other DNA
acaaacaccattgtcacactcca

SEQ ID NO: 4674 - DNA, 71 bp, synthetic construct
  source 1..71: mol_type = other DNA
acaaacaccattgtcacactccacacaaacaccattgtcacactccacacaaacaccattgtcacactcca

SEQ ID NO: 4675 - DNA, 23 bp, synthetic construct
  source 1..23: mol_type = other DNA
tccataaagtaggaaacactaca

SEQ ID NO: 4676 - DNA, 22 bp, synthetic construct
  source 1..22: mol_type = other DNA
agtgaattctaccagtgccata

SEQ ID NO: 4677 - DNA, 24 bp, synthetic construct
  source 1..24: mol_type = other DNA
agtgtgagttctaccattgccaaa

SEQ ID NO: 4678 - DNA, 23 bp, synthetic construct
  source 1..23: mol_type = other DNA
agcaaaaatgtgctagtgccaaa

SEQ ID NO: 4679 - DNA, 22 bp, synthetic construct
  source 1..22: mol_type = other DNA
atacatacttctttacattcca

SEQ ID NO: 4680 - protein, 7 aa, synthetic construct
TLAVPFK

SEQ ID NO: 4681 - protein, 18 aa, synthetic construct
KTINGSGSPHSKAQARKT

SEQ ID NO: 4682 - protein, 18 aa, synthetic construct
KYIVGSGSPHSKAQNQQT

SEQ ID NO: 4683 - protein, 18 aa, synthetic construct
KTINGSGSPHSMYMNQQT

SEQ ID NO: 4684 - protein, 18 aa, synthetic construct
KTINGSGSPHSKAFYRQT

SEQ ID NO: 4685 - protein, 18 aa, synthetic construct
KTINGSGSPHSKLKRQQT

SEQ ID NO: 4686 - protein, 18 aa, synthetic construct
KTINGSGSPHSKRHRQQT

SEQ ID NO: 4687 - protein, 18 aa, synthetic construct
KTINGSGSPHSKAQKCIT

SEQ ID NO: 4688 - protein, 18 aa, synthetic construct
KTINGSGSPHSKWRLQQT

SEQ ID NO: 4689 - protein, 18 aa, synthetic construct
KTINGSGSPHSRCRNQQT

SEQ ID NO: 4690 - protein, 18 aa, synthetic construct
KTINGSGSPHSFTCNQQT

SEQ ID NO: 4691 - protein, 18 aa, synthetic construct
KTINGSGSPHSKFFIQQT

SEQ ID NO: 4692 - protein, 18 aa, synthetic construct
KTINGSGSPHSKAQYSRT

SEQ ID NO: 4693 - protein, 18 aa, synthetic construct
KTINGSGSPHCALQNQQT

SEQ ID NO: 4694 - protein, 13 aa, synthetic construct
  VARIANT 7: note = S, C, F, or V
  VARIANT 8: note = K, L, R, I, E, Y, V, or S
  VARIANT 9: note = A, R, L, G, I, Y, S, F, or W
  VARIANT 10: note = W, Q, R, G, L, V, S, or F
  VARIANT 11: note = N, Y, R, C, K, or L
  VARIANT 12: note = Q, G, K, R, T, L, or Y
  VARIANT 13: note = Q, L, R, or V
GSGSPHXXXXXXX

SEQ ID NO: 4695 - protein, 6 aa, synthetic construct
GSGSPH

SEQ ID NO: 4696 - protein, 11 aa, synthetic construct
  VARIANT 7: note = S, I, F, V, C, Y, W, R, P, L, Q, M, K, or G
  VARIANT 8: note = K, M, R, F, V, C, P, Y, L, W, G, N, S, T, I, or A
  VARIANT 9: note = A, Y, L, R, W, C, T, F, H, I, P, M, K, S, V, G, Q, or N
  VARIANT 10: note = Q, M, F, K, H, R, C, W, P, V, L, G, S, Y, I, A, T, D, N, or E
  VARIANT 11: note = A, N, Y, R, K, L, I, M, Q, S, C, W, F, T, G, V, or P
GSGSPHXXXXX

SEQ ID NO: 4697 - protein, 9 aa, synthetic construct
GSGSPHSKA

SEQ ID NO: 4698 - protein, 9 aa, synthetic construct
GHDSPHKSG

SEQ ID NO: 4699 - protein, 12 aa, synthetic construct
  VARIANT 1: note = T, M, A, C, I, R, L, D, F, V, Q, N, or H
  VARIANT 2: note = I, P, E, N, D, S, A, T, M, or Q
  VARIANT 3: note = N, E, G, Y, W, M, T, I, K, Q, F, S, V, A, or L
  VARIANT 4: note = G, D, R, or E
  VARIANT 5: note = H, Q, N, or D
  VARIANT 6: note = D or R
XXXXXXSPHKSG

SEQ ID NO: 4700 - protein, 4 aa, synthetic construct
SPHS

SEQ ID NO: 4701 - protein, 5 aa, synthetic construct
SPHSK

SEQ ID NO: 4702 - protein, 4 aa, synthetic construct
HDSP

SEQ ID NO: 4703 - protein, 5 aa, synthetic construct
HDSPH

SEQ ID NO: 4704 - protein, 5 aa, synthetic construct
SPHKS

SEQ ID NO: 4705 - protein, 5 aa, synthetic construct
SPHAR

SEQ ID NO: 4706 - protein, 5 aa, synthetic construct
SPHVK

SEQ ID NO: 4707 - protein, 5 aa, synthetic construct
SPHAS

SEQ ID NO: 4708 - protein, 5 aa, synthetic construct
SPHKK

SEQ ID NO: 4709 - protein, 5 aa, synthetic construct
SPHVR

SEQ ID NO: 4710 - protein, 5 aa, synthetic construct
SPHRK

SEQ ID NO: 4711 - protein, 5 aa, synthetic construct
SPHKT

SEQ ID NO: 4712 - protein, 5 aa, synthetic construct
SPHKF

SEQ ID NO: 4713 - protein, 5 aa, synthetic construct
SPHKI

SEQ ID NO: 4714 - protein, 5 aa, synthetic construct
SPHKL

SEQ ID NO: 4715 - protein, 5 aa, synthetic construct
SPHKY

SEQ ID NO: 4716 - protein, 5 aa, synthetic construct
SPHTR

SEQ ID NO: 4717 - protein, 5 aa, synthetic construct
SPHKR

SEQ ID NO: 4718 - protein, 5 aa, synthetic construct
SPHGA

SEQ ID NO: 4719 - protein, 5 aa, synthetic construct
SPHSR

SEQ ID NO: 4720 - protein, 5 aa, synthetic construct
SPHSL

SEQ ID NO: 4721 - protein, 5 aa, synthetic construct
SPHSS

SEQ ID NO: 4722 - protein, 5 aa, synthetic construct
SPHFL

SEQ ID NO: 4723 - protein, 5 aa, synthetic construct
SPHWK

SEQ ID NO: 4724 - protein, 5 aa, synthetic construct
SPHGK

SEQ ID NO: 4725 - protein, 5 aa, synthetic construct
SPHTK

SEQ ID NO: 4726 - protein, 5 aa, synthetic construct
SPHNK

SEQ ID NO: 4727 - protein, 5 aa, synthetic construct
SPHAK

SEQ ID NO: 4728 - protein, 5 aa, synthetic construct
SPHKH

SEQ ID NO: 4729 - protein, 5 aa, synthetic construct
SPHKM

SEQ ID NO: 4730 - protein, 5 aa, synthetic construct
SPHRS

SEQ ID NO: 4731 - protein, 6 aa, synthetic construct
SPHSKT

SEQ ID NO: 4732 - protein, 6 aa, synthetic construct
SPHSKG

SEQ ID NO: 4733 - protein, 6 aa, synthetic construct
SPHGKA

SEQ ID NO: 4734 - protein, 6 aa, synthetic construct
SPHNKA

SEQ ID NO: 4735 - protein, 6 aa, synthetic construct
SPHSKN

SEQ ID NO: 4736 - protein, 6 aa, synthetic construct
SPHAKA

SEQ ID NO: 4737 - protein, 6 aa, synthetic construct
SPHSKV

SEQ ID NO: 4738 - protein, 6 aa, synthetic construct
SPHKTG

SEQ ID NO: 4739 - protein, 6 aa, synthetic construct
SPHTKA

SEQ ID NO: 4740 - protein, 6 aa, synthetic construct
SPHKSL

SEQ ID NO: 4741 - protein, 6 aa, synthetic construct
SPHKSE

SEQ ID NO: 4742 - protein, 6 aa, synthetic construct
SPHKSV

SEQ ID NO: 4743 - protein, 6 aa, synthetic construct
SPHKSW

SEQ ID NO: 4744 - protein, 6 aa, synthetic construct
SPHKSN

SEQ ID NO: 4745 - protein, 6 aa, synthetic construct
SPHKHG

SEQ ID NO: 4746 - protein, 6 aa, synthetic construct
SPHKSQ

SEQ ID NO: 4747 - protein, 6 aa, synthetic construct
SPHKSK

SEQ ID NO: 4748 - protein, 6 aa, synthetic construct
SPHKLW

SEQ ID NO: 4749 - protein, 6 aa, synthetic construct
SPHWKG

SEQ ID NO: 4750 - protein, 6 aa, synthetic construct
SPHKMG

SEQ ID NO: 4751 - protein, 6 aa, synthetic construct
SPHKMA

SEQ ID NO: 4752 - protein, 5 aa, synthetic construct
SGSPH

SEQ ID NO: 4753 - protein, 5 aa, synthetic construct
QDSPH

SEQ ID NO: 4754 - protein, 5 aa, synthetic construct
RGSPH

SEQ ID NO: 4755 - protein, 5 aa, synthetic construct
SHSPH

SEQ ID NO: 4756 - protein, 5 aa, synthetic construct
QSSPH

SEQ ID NO: 4757 - protein, 5 aa, synthetic construct
DDSPH

SEQ ID NO: 4758 - protein, 5 aa, synthetic construct
HESPH

SEQ ID NO: 4759 - protein, 5 aa, synthetic construct
NYSPH

SEQ ID NO: 4760 - protein, 5 aa, synthetic construct
VGSPH

SEQ ID NO: 4761 - protein, 5 aa, synthetic construct
SCSPH

SEQ ID NO: 4762 - protein, 5 aa, synthetic construct
LLSPH

SEQ ID NO: 4763 - protein, 5 aa, synthetic construct
NGSPH

SEQ ID NO: 4764 - protein, 5 aa, synthetic construct
PGSPH

SEQ ID NO: 4765 - protein, 5 aa, synthetic construct
GGSPH

SEQ ID NO: 4766 - protein, 5 aa, synthetic construct
TGSPH

SEQ ID NO: 4767 - protein, 5 aa, synthetic construct
SVSPH

SEQ ID NO: 4768 - protein, 5 aa, synthetic construct
IGSPH

SEQ ID NO: 4769 - protein, 5 aa, synthetic construct
DGSPH

SEQ ID NO: 4770 - protein, 5 aa, synthetic construct
LGSPH

SEQ ID NO: 4771 - protein, 5 aa, synthetic construct
AGSPH

SEQ ID NO: 4772 - protein, 5 aa, synthetic construct
EGSPH

SEQ ID NO: 4773 - protein, 5 aa, synthetic construct
SASPH

SEQ ID NO: 4774 - protein, 5 aa, synthetic construct
YDSPH

SEQ ID NO: 4775 - protein, 5 aa, synthetic construct
HGSPH

SEQ ID NO: 4776 - protein, 5 aa, synthetic construct
RDSPH

SEQ ID NO: 4777 - protein, 5 aa, synthetic construct
NDSPH

SEQ ID NO: 4778 - protein, 5 aa, synthetic construct
PDSPH

SEQ ID NO: 4779 - protein, 5 aa, synthetic construct
MGSPH

SEQ ID NO: 4780 - protein, 5 aa, synthetic construct
QVSPH

SEQ ID NO: 4781 - protein, 5 aa, synthetic construct
HNSPH

SEQ ID NO: 4782 - protein, 5 aa, synthetic construct
HPSPH

SEQ ID NO: 4783 - protein, 5 aa, synthetic construct
HSSPH

SEQ ID NO: 4784 - protein, 6 aa, synthetic construct
GHDSPH

SEQ ID NO: 4785 - protein, 6 aa, synthetic construct
GQDSPH

SEQ ID NO: 4786 - protein, 6 aa, synthetic construct
VSGSPH

SEQ ID NO: 4787 - protein, 6 aa, synthetic construct
CSGSPH

SEQ ID NO: 4788 - protein, 6 aa, synthetic construct
GRGSPH

SEQ ID NO: 4789 - protein, 6 aa, synthetic construct
CSHSPH

SEQ ID NO: 4790 - protein, 6 aa, synthetic construct
GQSSPH

SEQ ID NO: 4791 - protein, 6 aa, synthetic construct
GSHSPH

SEQ ID NO: 4792 - protein, 6 aa, synthetic construct
GDDSPH

SEQ ID NO: 4793 - protein, 6 aa, synthetic construct
GHESPH

SEQ ID NO: 4794 - protein, 6 aa, synthetic construct
GNYSPH

SEQ ID NO: 4795 - protein, 6 aa, synthetic construct
RVGSPH

SEQ ID NO: 4796 - protein, 6 aa, synthetic construct
GSCSPH

SEQ ID NO: 4797 - protein, 6 aa, synthetic construct
GLLSPH

SEQ ID NO: 4798 - protein, 6 aa, synthetic construct
MSGSPH

SEQ ID NO: 4799 - protein, 6 aa, synthetic construct
RNGSPH

SEQ ID NO: 4800 - protein, 6 aa, synthetic construct
TSGSPH

SEQ ID NO: 4801 - protein, 6 aa, synthetic construct
ISGSPH

SEQ ID NO: 4802 - protein, 6 aa, synthetic construct
GPGSPH

SEQ ID NO: 4803 - protein, 6 aa, synthetic construct
ESGSPH

SEQ ID NO: 4804 - protein, 6 aa, synthetic construct
SSGSPH

SEQ ID NO: 4805 - protein, 6 aa, synthetic construct
GNGSPH

SEQ ID NO: 4806 - protein, 6 aa, synthetic construct
ASGSPH

SEQ ID NO: 4807 - protein, 6 aa, synthetic construct
NSGSPH

SEQ ID NO: 4808 - protein, 6 aa, synthetic construct
LSGSPH

SEQ ID NO: 4809 - protein, 6 aa, synthetic construct
GGGSPH

SEQ ID NO: 4810 - protein, 6 aa, synthetic construct
KSGSPH

SEQ ID NO: 4811 - protein, 6 aa, synthetic construct
HSGSPH

SEQ ID NO: 4812 - protein, 6 aa, synthetic construct
GTGSPH

SEQ ID NO: 4813 - protein, 6 aa, synthetic construct
PSGSPH

SEQ ID NO: 4814 - protein, 6 aa, synthetic construct
GSVSPH

SEQ ID NO: 4815 - protein, 6 aa, synthetic construct
RSGSPH

SEQ ID NO: 4816 - protein, 6 aa, synthetic construct
GIGSPH

SEQ ID NO: 4817 - protein, 6 aa, synthetic construct
WSGSPH

SEQ ID NO: 4818 - protein, 6 aa, synthetic construct
DSGSPH

SEQ ID NO: 4819 - protein, 6 aa, synthetic construct
IDGSPH

SEQ ID NO: 4820 - protein, 6 aa, synthetic construct
GLGSPH

SEQ ID NO: 4821 - protein, 6 aa, synthetic construct
DAGSPH

SEQ ID NO: 4822 - protein, 6 aa, synthetic construct
DGGSPH

SEQ ID NO: 4823 - protein, 6 aa, synthetic construct
MEGSPH

SEQ ID NO: 4824 - protein, 6 aa, synthetic construct
ENGSPH

SEQ ID NO: 4825 - protein, 6 aa, synthetic construct
GSASPH

SEQ ID NO: 4826 - protein, 6 aa, synthetic construct
KNGSPH

SEQ ID NO: 4827 - protein, 6 aa, synthetic construct
KEGSPH

SEQ ID NO: 4828 - protein, 6 aa, synthetic construct
AIGSPH

SEQ ID NO: 4829 - protein, 6 aa, synthetic construct
GYDSPH

SEQ ID NO: 4830 - protein, 6 aa, synthetic construct
GHGSPH

SEQ ID NO: 4831 - protein, 6 aa, synthetic construct
GRDSPH

SEQ ID NO: 4832 - protein, 6 aa, synthetic construct
GNDSPH

SEQ ID NO: 4833 - protein, 6 aa, synthetic construct
GPDSPH

SEQ ID NO: 4834 - protein, 6 aa, synthetic construct
GMGSPH

SEQ ID NO: 4835 - protein, 6 aa, synthetic construct
GQVSPH

SEQ ID NO: 4836 - protein, 6 aa, synthetic construct
GHNSPH

SEQ ID NO: 4837 - protein, 6 aa, synthetic construct
GHPSPH

SEQ ID NO: 4838 - protein, 6 aa, synthetic construct
GHSSPH

SEQ ID NO: 4839 - protein, 7 aa, synthetic construct
SGSPHSK

SEQ ID NO: 4840 - protein, 7 aa, synthetic construct
HDSPHKS

SEQ ID NO: 4841 - protein, 7 aa, synthetic construct
SGSPHAR

SEQ ID NO: 4842 - protein, 7 aa, synthetic construct
SGSPHVK

SEQ ID NO: 4843 - protein, 7 aa, synthetic construct
QDSPHKS

SEQ ID NO: 4844 - protein, 7 aa, synthetic construct
SGSPHKK

SEQ ID NO: 4845 - protein, 7 aa, synthetic construct
SGSPHVR

SEQ ID NO: 4846 - protein, 7 aa, synthetic construct
SGSPHAS

SEQ ID NO: 4847 - protein, 7 aa, synthetic construct
SGSPHRK

SEQ ID NO: 4848 - protein, 7 aa, synthetic construct
SGSPHKT

SEQ ID NO: 4849 - protein, 7 aa, synthetic construct
SHSPHKS

SEQ ID NO: 4850 - protein, 7 aa, synthetic construct
QSSPHRS

SEQ ID NO: 4851 - protein, 7 aa, synthetic construct
RGSPHAS

SEQ ID NO: 4852 - protein, 7 aa, synthetic construct
RGSPHSK

SEQ ID NO: 4853 - protein, 7 aa, synthetic construct
SGSPHKF

SEQ ID NO: 4854 - protein, 7 aa, synthetic construct
SGSPHKI

SEQ ID NO: 4855 - protein, 7 aa, synthetic construct
SGSPHKL

SEQ ID NO: 4856 - protein, 7 aa, synthetic construct
SGSPHKY

SEQ ID NO: 4857 - protein, 7 aa, synthetic construct
SGSPHTR

SEQ ID NO: 4858 - protein, 7 aa, synthetic construct
SHSPHKR

SEQ ID NO: 4859 - protein, 7 aa, synthetic construct
SGSPHGA

SEQ ID NO: 4860 - protein, 7 aa, synthetic construct
HDSPHKR

SEQ ID NO: 4861 - protein, 7 aa, synthetic construct
DDSPHKS

SEQ ID NO: 4862 - protein, 7 aa, synthetic construct
HESPHKS

SEQ ID NO: 4863 - protein, 7 aa, synthetic construct
NYSPHKI

SEQ ID NO: 4864 - protein, 7 aa, synthetic construct
SGSPHSR

SEQ ID NO: 4865 - protein, 7 aa, synthetic construct
SGSPHSL

SEQ ID NO: 4866 - protein, 7 aa, synthetic construct
SGSPHSS

SEQ ID NO: 4867 - protein, 7 aa, synthetic construct
VGSPHSK

SEQ ID NO: 4868 - protein, 7 aa, synthetic construct
SCSPHRK

SEQ ID NO: 4869 - protein, 7 aa, synthetic construct
SGSPHFL

SEQ ID NO: 4870 - protein, 7 aa, synthetic construct
LLSPHWK

SEQ ID NO: 4871 - protein, 7 aa, synthetic construct
NGSPHSK

SEQ ID NO: 4872 - protein, 7 aa, synthetic construct
PGSPHSK

SEQ ID NO: 4873 - protein, 7 aa, synthetic construct
GGSPHSK

SEQ ID NO: 4874 - protein, 7 aa, synthetic construct
TGSPHSK

SEQ ID NO: 4875 - protein, 7 aa, synthetic construct
SVSPHGK

SEQ ID NO: 4876 - protein, 7 aa, synthetic construct
SGSPHTK

SEQ ID NO: 4877 - protein, 7 aa, synthetic construct
IGSPHSK

SEQ ID NO: 4878 - protein, 7 aa, synthetic construct
DGSPHSK

SEQ ID NO: 4879 - protein, 7 aa, synthetic construct
SGSPHNK

SEQ ID NO: 4880 - protein, 7 aa, synthetic construct
LGSPHSK

SEQ ID NO: 4881 - protein, 7 aa, synthetic construct
AGSPHSK

SEQ ID NO: 4882 - protein, 7 aa, synthetic construct
EGSPHSK

SEQ ID NO: 4883 - protein, 7 aa, synthetic construct
SASPHSK

SEQ ID NO: 4884 - protein, 7 aa, synthetic construct
SGSPHAK

SEQ ID NO: 4885 - protein, 7 aa, synthetic construct
HDSPHKI

SEQ ID NO: 4886 - protein, 7 aa, synthetic construct
YDSPHKS

SEQ ID NO: 4887 - protein, 7 aa, synthetic construct
HDSPHKT

SEQ ID NO: 4888 - protein, 7 aa, synthetic construct
RGSPHKR

SEQ ID NO: 4889 - protein, 7 aa, synthetic construct
HGSPHSK

SEQ ID NO: 4890 - protein, 7 aa, synthetic construct
RDSPHKS

SEQ ID NO: 4891 - protein, 7 aa, synthetic construct
NDSPHKS

SEQ ID NO: 4892 - protein, 7 aa, synthetic construct
QDSPHKI

SEQ ID NO: 4893 - protein, 7 aa, synthetic construct
PDSPHKI

SEQ ID NO: 4894 - protein, 7 aa, synthetic construct
PDSPHKS

SEQ ID NO: 4895 - protein, 7 aa, synthetic construct
MGSPHSK

SEQ ID NO: 4896 - protein, 7 aa, synthetic construct
HDSPHKH

SEQ ID NO: 4897 - protein, 7 aa, synthetic construct
QVSPHKS

SEQ ID NO: 4898 - protein, 7 aa, synthetic construct
HNSPHKS

SEQ ID NO: 4899 - protein, 7 aa, synthetic construct
NGSPHKR

SEQ ID NO: 4900 - protein, 7 aa, synthetic construct
HDSPHKY

SEQ ID NO: 4901 - protein, 7 aa, synthetic construct
NDSPHKI

SEQ ID NO: 4902 - protein, 7 aa, synthetic construct
HDSPHKL

SEQ ID NO: 4903 - protein, 7 aa, synthetic construct
HPSPHWK

SEQ ID NO: 4904 - protein, 7 aa, synthetic construct
HDSPHKM

SEQ ID NO: 4905 - protein, 7 aa, synthetic construct
HSSPHRS

SEQ ID NO: 4906 - protein, 9 aa, synthetic construct
GSGSPHARM

SEQ ID NO: 4907 - protein, 9 aa, synthetic construct
GSGSPHVKS

SEQ ID NO: 4908 - protein, 9 aa, synthetic construct
GQDSPHKSG

SEQ ID NO: 4909 - protein, 9 aa, synthetic construct
GSGSPHASR

SEQ ID NO: 4910 - protein, 9 aa, synthetic construct
GSGSPHVKI

SEQ ID NO: 4911 - protein, 9 aa, synthetic construct
GSGSPHKKN

SEQ ID NO: 4912 - protein, 9 aa, synthetic construct
GSGSPHVRM

SEQ ID NO: 4913 - protein, 9 aa, synthetic construct
VSGSPHSKA

SEQ ID NO: 4914 - protein, 9 aa, synthetic construct
CSGSPHSKA

SEQ ID NO: 4915 - protein, 9 aa, synthetic construct
GSGSPHRKA

SEQ ID NO: 4916 - protein, 9 aa, synthetic construct
CSGSPHKTS

SEQ ID NO: 4917 - protein, 9 aa, synthetic construct
CSHSPHKSG

SEQ ID NO: 4918 - protein, 9 aa, synthetic construct
GQSSPHRSG

SEQ ID NO: 4919 - protein, 9 aa, synthetic construct
GRGSPHASR

SEQ ID NO: 4920 - protein, 9 aa, synthetic construct
GRGSPHSKA

SEQ ID NO: 4921 - protein, 9 aa, synthetic construct
GSGSPHKFG

SEQ ID NO: 4922 - protein, 9 aa, synthetic construct
GSGSPHKIG

SEQ ID NO: 4923 - protein, 9 aa, synthetic construct
GSGSPHKLG

SEQ ID NO: 4924 - protein, 9 aa, synthetic construct
GSGSPHKTS

SEQ ID NO: 4925 - protein, 9 aa, synthetic construct
GSGSPHKTT

SEQ ID NO: 4926 - protein, 9 aa, synthetic construct
GSGSPHKTY

SEQ ID NO: 4927 - protein, 9 aa, synthetic construct
GSGSPHKYG

SEQ ID NO: 4928 - protein, 9 aa, synthetic construct
GSGSPHSKD

SEQ ID NO: 4929 - protein, 9 aa, synthetic construct
GSGSPHSKP

SEQ ID NO: 4930 - protein, 9 aa, synthetic construct
GSGSPHTRG

SEQ ID NO: 4931 - protein, 9 aa, synthetic construct
GSGSPHVRG

SEQ ID NO: 4932 - protein, 9 aa, synthetic construct
GSHSPHKRG

SEQ ID NO: 4933 - protein, 9 aa, synthetic construct
GSHSPHKSG

SEQ ID NO: 4934 - protein, 9 aa, synthetic construct
VSGSPHASR

SEQ ID NO: 4935 - protein, 9 aa, synthetic construct
VSGSPHGAR

SEQ ID NO: 4936 - protein, 9 aa, synthetic construct
VSGSPHKFG

SEQ ID NO: 4937 - protein, 9 aa, synthetic construct
GHDSPHKRG

SEQ ID NO: 4938 - protein, 9 aa, synthetic construct
GDDSPHKSG

SEQ ID NO: 4939 - protein, 9 aa, synthetic construct
GHESPHKSA

SEQ ID NO: 4940 - protein, 9 aa, synthetic construct
GHDSPHKSA

SEQ ID NO: 4941 - protein, 9 aa, synthetic construct
GNYSPHKIG

SEQ ID NO: 4942 - protein, 9 aa, synthetic construct
GHDSPHKSR

SEQ ID NO: 4943 - protein, 9 aa, synthetic construct
GSGSPHSKL

SEQ ID NO: 4944 - protein, 9 aa, synthetic construct
GSGSPHSRA

SEQ ID NO: 4945 - protein, 9 aa, synthetic construct
GSGSPHSKR

SEQ ID NO: 4946 - protein, 9 aa, synthetic construct
GSGSPHSLR

SEQ ID NO: 4947 - protein, 9 aa, synthetic construct
GSGSPHSRG

SEQ ID NO: 4948 - protein, 9 aa, synthetic construct
GSGSPHSSR

SEQ ID NO: 4949 - protein, 9 aa, synthetic construct
RVGSPHSKA

SEQ ID NO: 4950 - protein, 9 aa, synthetic construct
GSCSPHRKA

SEQ ID NO: 4951 - protein, 9 aa, synthetic construct
GSGSPHFLR

SEQ ID NO: 4952 - protein, 9 aa, synthetic construct
GSGSPHSKW

SEQ ID NO: 4953 - protein, 9 aa, synthetic construct
GSGSPHSKS

SEQ ID NO: 4954 - protein, 9 aa, synthetic construct
GLLSPHWKA

SEQ ID NO: 4955 - protein, 9 aa, synthetic construct
GSGSPHVRR

SEQ ID NO: 4956 - protein, 9 aa, synthetic construct
GSGSPHSKV

SEQ ID NO: 4957 - protein, 9 aa, synthetic construct
MSGSPHSKA

SEQ ID NO: 4958 - protein, 9 aa, synthetic construct
RNGSPHSKA

SEQ ID NO: 4959 - protein, 9 aa, synthetic construct
TSGSPHSKA

SEQ ID NO: 4960 - protein, 9 aa, synthetic construct
ISGSPHSKA

SEQ ID NO: 4961 - protein, 9 aa, synthetic construct
GPGSPHSKA

SEQ ID NO: 4962 - protein, 9 aa, synthetic construct
GSGSPHSKT

SEQ ID NO: 4963 - protein, 9 aa, synthetic construct
ESGSPHSKA

SEQ ID NO: 4964 - protein, 9 aa, synthetic construct
SSGSPHSKA

SEQ ID NO: 4965 - protein, 9 aa, synthetic construct
GNGSPHSKA

SEQ ID NO: 4966 - protein, 9 aa, synthetic construct
ASGSPHSKA

SEQ ID NO: 4967 - protein, 9 aa, synthetic construct
NSGSPHSKA

SEQ ID NO: 4968 - protein, 9 aa, synthetic construct
LSGSPHSKA

SEQ ID NO: 4969 - protein, 9 aa, synthetic construct
GGGSPHSKA

SEQ ID NO: 4970 - protein, 9 aa, synthetic construct
KSGSPHSKA

SEQ ID NO: 4971 - protein, 9 aa, synthetic construct
GGGSPHSKS

SEQ ID NO: 4972 - protein, 9 aa, synthetic construct
GSGSPHSKG

SEQ ID NO: 4973 - protein, 9 aa, synthetic construct
HSGSPHSKA

SEQ ID NO: 4974 - protein, 9 aa, synthetic construct
GTGSPHSKA

SEQ ID NO: 4975 - protein, 9 aa, synthetic construct
PSGSPHSKA

SEQ ID NO: 4976 - protein, 9 aa, synthetic construct
GSVSPHGKA

SEQ ID NO: 4977 - protein, 9 aa, synthetic construct
RSGSPHSKA

SEQ ID NO: 4978 - protein, 9 aa, synthetic construct
GSGSPHTKA

SEQ ID NO: 4979 - protein, 9 aa, synthetic construct
GIGSPHSKA

SEQ ID NO: 4980 - protein, 9 aa, synthetic construct
WSGSPHSKA

SEQ ID NO: 4981 - protein, 9 aa, synthetic construct
DSGSPHSKA

SEQ ID NO: 4982 - protein, 9 aa, synthetic construct
IDGSPHSKA

SEQ ID NO: 4983 - protein, 9 aa, synthetic construct
GSGSPHNKA

SEQ ID NO: 4984 - protein, 9 aa, synthetic construct
GLGSPHSKS

SEQ ID NO: 4985 - protein, 9 aa, synthetic construct
DAGSPHSKA

SEQ ID NO: 4986 - protein, 9 aa, synthetic construct
DGGSPHSKA

SEQ ID NO: 4987 - protein, 9 aa, synthetic construct
MEGSPHSKA

SEQ ID NO: 4988 - protein, 9 aa, synthetic construct
ENGSPHSKA

SEQ ID NO: 4989 - protein, 9 aa, synthetic construct
GSASPHSKA

SEQ ID NO: 4990 - protein, 9 aa, synthetic construct
GNGSPHSKS

SEQ ID NO: 4991 - protein, 9 aa, synthetic construct
KNGSPHSKA

SEQ ID NO: 4992 - protein, 9 aa, synthetic construct
KEGSPHSKA

SEQ ID NO: 4993 - protein, 9 aa, synthetic construct
AIGSPHSKA

SEQ ID NO: 4994 - protein, 9 aa, synthetic construct
GSGSPHSKN

SEQ ID NO: 4995 - protein, 9 aa, synthetic construct
GSGSPHAKA

SEQ ID NO: 4996 - protein, 9 aa, synthetic construct
GHDSPHKIG

SEQ ID NO: 4997 - protein, 9 aa, synthetic construct
GYDSPHKSG

SEQ ID NO: 4998 - protein, 9 aa, synthetic construct
GHESPHKSG

SEQ ID NO: 4999 - protein, 9 aa, synthetic construct
GHDSPHKTG

SEQ ID NO: 5000 - protein, 9 aa, synthetic construct
GRGSPHKRG

SEQ ID NO: 5001 - protein, 9 aa, synthetic construct
GHDSPHKSL

SEQ ID NO: 5002 - protein, 9 aa, synthetic construct
GHGSPHSKA

SEQ ID NO: 5003 - protein, 9 aa, synthetic construct
GHDSPHKSE

SEQ ID NO: 5004 - protein, 9 aa, synthetic construct
GRDSPHKSG

SEQ ID NO: 5005 - protein, 9 aa, synthetic construct
GNDSPHKSV

SEQ ID NO: 5006 - protein, 9 aa, synthetic construct
GQDSPHKIG

SEQ ID NO: 5007 - protein, 9 aa, synthetic construct
GHDSPHKSV

SEQ ID NO: 5008 - protein, 9 aa, synthetic construct
GPDSPHKIG

SEQ ID NO: 5009 - protein, 9 aa, synthetic construct
GPDSPHKSG

SEQ ID NO: 5010 - protein, 9 aa, synthetic construct
GHDSPHKSW

SEQ ID NO: 5011 - protein, 9 aa, synthetic construct
GHDSPHKSN

SEQ ID NO: 5012 - protein, 9 aa, synthetic construct
GMGSPHSKT

SEQ ID NO: 5013 - protein, 9 aa, synthetic construct
GHDSPHKHG

SEQ ID NO: 5014 - protein, 9 aa, synthetic construct
GQVSPHKSG

SEQ ID NO: 5015 - protein, 9 aa, synthetic construct
GDDSPHKSV

SEQ ID NO: 5016 - protein, 9 aa, synthetic construct
GHNSPHKSG

SEQ ID NO: 5017 - protein, 9 aa, synthetic construct
GNGSPHKRG

SEQ ID NO: 5018 - protein, 9 aa, synthetic construct
GHDSPHKYG

SEQ ID NO: 5019 - protein, 9 aa, synthetic construct
GHDSPHKSQ

SEQ ID NO: 5020 - protein, 9 aa, synthetic construct
GNDSPHKIG

SEQ ID NO: 5021 - protein, 9 aa, synthetic construct
GHDSPHKSK

SEQ ID NO: 5022 - protein, 9 aa, synthetic construct
GHDSPHKLW

SEQ ID NO: 5023 - protein, 9 aa, synthetic construct
GHPSPHWKG

SEQ ID NO: 5024 - protein, 9 aa, synthetic construct
GHDSPHKMG

SEQ ID NO: 5025 - protein, 9 aa, synthetic construct
GHDSPHKMA

SEQ ID NO: 5026 - protein, 9 aa, synthetic construct
GHSSPHRSG

SEQ ID NO: 5027 - protein, 8 aa, synthetic construct
SGSPHKYG

SEQ ID NO: 5028 - protein, 4 aa, synthetic construct
QNQQ

SEQ ID NO: 5029 - protein, 4 aa, synthetic construct
WNQQ

SEQ ID NO: 5030 - protein, 4 aa, synthetic construct
QYYV

SEQ ID NO: 5031 - protein, 4 aa, synthetic construct
RRQQ

SEQ ID NO: 5032 - protein, 4 aa, synthetic construct
GCGQ

SEQ ID NO: 5033 - protein, 4 aa, synthetic construct
LRQQ

SEQ ID NO: 5034 - protein, 4 aa, synthetic construct
RNQQ

SEQ ID NO: 5035 - protein, 4 aa, synthetic construct
VNQQ

SEQ ID NO: 5036 - protein, 4 aa, synthetic construct
FRLQ

SEQ ID NO: 5037 - protein, 4 aa, synthetic construct
FNQQ

SEQ ID NO: 5038 - protein, 4 aa, synthetic construct
LLQQ

SEQ ID NO: 5039 - protein, 4 aa, synthetic construct
SNQQ

SEQ ID NO: 5040 - protein, 4 aa, synthetic construct
RLQQ

SEQ ID NO: 5041 - protein, 4 aa, synthetic construct
LNQQ

SEQ ID NO: 5042 - protein, 4 aa, synthetic construct
QRKL

SEQ ID NO: 5043 - protein, 4 aa, synthetic construct
LRRQ

SEQ ID NO: 5044 - protein, 4 aa, synthetic construct
QRLR

SEQ ID NO: 5045 - protein, 4 aa, synthetic construct
QRRL

SEQ ID NO: 5046 - protein, 4 aa, synthetic construct
RRLQ

SEQ ID NO: 5047 - protein, 4 aa, synthetic construct
RLRQ

SEQ ID NO: 5048 - protein, 4 aa, synthetic construct
SKRQ

SEQ ID NO: 5049 - protein, 4 aa, synthetic construct
QLYR

SEQ ID NO: 5050 - protein, 4 aa, synthetic construct
QLTV

SEQ ID NO: 5051 - protein, 4 aa, synthetic construct
QNKQ

SEQ ID NO: 5052 - protein, 4 aa, synthetic construct
KNQQ

SEQ ID NO: 5053 - protein, 4 aa, synthetic construct
QKQQ

SEQ ID NO: 5054 - protein, 4 aa, synthetic construct
QTQQ

SEQ ID NO: 5055 - protein, 4 aa, synthetic construct
QNHQ

SEQ ID NO: 5056 - protein, 4 aa, synthetic construct
QHQQ

SEQ ID NO: 5057 - protein, 4 aa, synthetic construct
QNQH

SEQ ID NO: 5058 - protein, 4 aa, synthetic construct
QHRQ

SEQ ID NO: 5059 - protein, 4 aa, synthetic construct
LTQQ

SEQ ID NO: 5060 - protein, 4 aa, synthetic construct
QNQW

SEQ ID NO: 5061 - protein, 4 aa, synthetic construct
QNTH

SEQ ID NO: 5062 - protein, 4 aa, synthetic construct
RRRQ

SEQ ID NO: 5063 - protein, 4 aa, synthetic construct
QYQQ

SEQ ID NO: 5064 - protein, 4 aa, synthetic construct
QNDQ

SEQ ID NO: 5065 - protein, 4 aa, synthetic construct
QNRH

SEQ ID NO: 5066 - protein, 4 aa, synthetic construct
RDQQ

SEQ ID NO: 5067 - protein, 4 aa, synthetic construct
PNLQ

SEQ ID NO: 5068 - protein, 4 aa, synthetic construct
HVRQ

SEQ ID NO: 5069 - protein, 4 aa, synthetic construct
PNQH

SEQ ID NO: 5070 - protein, 4 aa, synthetic construct
HNQQ

SEQ ID NO: 5071 - protein, 4 aa, synthetic construct
QSQQ

SEQ ID NO: 5072 - protein, 4 aa, synthetic construct
QPAK

SEQ ID NO: 5073 - protein, 4 aa, synthetic construct
QNLA

SEQ ID NO: 5074 - protein, 4 aa, synthetic construct
QNQL

SEQ ID NO: 5075 - protein, 4 aa, synthetic construct
QGQQ

SEQ ID NO: 5076 - protein, 4 aa, synthetic construct
LNRQ

SEQ ID NO: 5077 - protein, 4 aa, synthetic construct
QNPP

SEQ ID NO: 5078 - protein, 4 aa, synthetic construct
QNLQ

SEQ ID NO: 5079 - protein, 4 aa, synthetic construct
QDQE

SEQ ID NO: 5080 - protein, 4 aa, synthetic construct
QDQQ

SEQ ID NO: 5081 - protein, 4 aa, synthetic construct
HWQQ

SEQ ID NO: 5082 - protein, 4 aa, synthetic construct
PNQQ

SEQ ID NO: 5083 - protein, 4 aa, synthetic construct
PEQQ

SEQ ID NO: 5084 - protein, 4 aa, synthetic construct
QRTM

SEQ ID NO: 5085 - protein, 4 aa, synthetic construct
LHQH

SEQ ID NO: 5086 - protein, 4 aa, synthetic construct
QHRI

SEQ ID NO: 5087 - protein, 4 aa, synthetic construct
QYIH

SEQ ID NO: 5088 - protein, 4 aa, synthetic construct
QKFE

SEQ ID NO: 5089 - protein, 4 aa, synthetic construct
QFPS

SEQ ID NO: 5090 - protein, 4 aa, synthetic construct
QNPL

SEQ ID NO: 5091 - protein, 4 aa, synthetic construct
QAIK

SEQ ID NO: 5092 - protein, 4 aa, synthetic construct
QNRQ

SEQ ID NO: 5093 - protein, 4 aa, synthetic construct
QYQH

SEQ ID NO: 5094 - protein, 4 aa, synthetic construct
QNPQ

SEQ ID NO: 5095 - protein, 4 aa, synthetic construct
QHQL

SEQ ID NO: 5096 - protein, 4 aa, synthetic construct
QSPP

SEQ ID NO: 5097 - protein, 4 aa, synthetic construct
QAKL

SEQ ID NO: 5098 - protein, 4 aa, synthetic construct
KSQQ

SEQ ID NO: 5099 - protein, 4 aa, synthetic construct
QDRP

SEQ ID NO: 5100 - protein, 4 aa, synthetic construct
QNLG

SEQ ID NO: 5101 - protein, 4 aa, synthetic construct
QAFH

SEQ ID NO: 5102 - protein, 4 aa, synthetic construct
QNAQ

SEQ ID NO: 5103 - protein, 4 aa, synthetic construct
HNQL

SEQ ID NO: 5104 - protein, 4 aa, synthetic construct
QKLN

SEQ ID NO: 5105 - protein, 4 aa, synthetic construct
QNVQ

SEQ ID NO: 5106 - protein, 4 aa, synthetic construct
QAQQ

SEQ ID NO: 5107 - protein, 4 aa, synthetic construct
QTPP

SEQ ID NO: 5108 - protein, 4 aa, synthetic construct
QPPA

SEQ ID NO: 5109 - protein, 4 aa, synthetic construct
QERP

SEQ ID NO: 5110 - protein, 4 aa, synthetic construct
QDLQ

SEQ ID NO: 5111 - protein, 4 aa, synthetic construct
QAMH

SEQ ID NO: 5112 - protein, 4 aa, synthetic construct
QHPS

SEQ ID NO: 5113 - protein, 4 aa, synthetic construct
PGLQ

SEQ ID NO: 5114 - protein, 4 aa, synthetic construct
QGIR

SEQ ID NO: 5115 - protein, 4 aa, synthetic construct
QAPA

SEQ ID NO: 5116 - protein, 4 aa, synthetic construct
QIPP

SEQ ID NO: 5117 - protein, 4 aa, synthetic construct
QTQL

SEQ ID NO: 5118 - protein, 4 aa, synthetic construct
QAPS

SEQ ID NO: 5119 - protein, 4 aa, synthetic construct
QNTY

SEQ ID NO: 5120 - protein, 4 aa, synthetic construct
QDKQ

SEQ ID NO: 5121 - protein, 4 aa, synthetic construct
QNHL

SEQ ID NO: 5122 - protein, 4 aa, synthetic construct
QIGM

SEQ ID NO: 5123 - protein, 4 aa, synthetic construct
LNKQ

SEQ ID NO: 5124 - protein, 4 aa, synthetic construct
PNQL

SEQ ID NO: 5125 - protein, 4 aa, synthetic construct
QLQQ

SEQ ID NO: 5126 - protein, 4 aa, synthetic construct
QRMS

SEQ ID NO: 5127 - protein, 4 aa, synthetic construct
QGIL

SEQ ID NO: 5128 - protein, 4 aa, synthetic construct
QDRQ

SEQ ID NO: 5129 - protein, 4 aa, synthetic construct
RDWQ

SEQ ID NO: 5130 - protein, 4 aa, synthetic construct
QERS

SEQ ID NO: 5131 - protein, 4 aa, synthetic construct
QNYQ

SEQ ID NO: 5132 - protein, 4 aa, synthetic construct
QRTC

SEQ ID NO: 5133 - protein, 4 aa, synthetic construct
QIGH

SEQ ID NO: 5134 - protein, 4 aa, synthetic construct
QGAI

SEQ ID NO: 5135 - protein, 4 aa, synthetic construct
QVPP

SEQ ID NO: 5136 - protein, 4 aa, synthetic construct
QVQQ

SEQ ID NO: 5137 - protein, 4 aa, synthetic construct
LMRQ

SEQ ID NO: 5138 - protein, 4 aa, synthetic construct
QYSV

SEQ ID NO: 5139 - protein, 4 aa, synthetic construct
QAIT

SEQ ID NO: 5140 - protein, 4 aa, synthetic construct
QKTL

SEQ ID NO: 5141 - protein, 4 aa, synthetic construct
QLHH

SEQ ID NO: 5142 - protein, 4 aa, synthetic construct
QNII

SEQ ID NO: 5143 - protein, 4 aa, synthetic construct
QGHH

SEQ ID NO: 5144 - protein, 4 aa, synthetic construct
QSKV

SEQ ID NO: 5145 - protein, 4 aa, synthetic construct
QLPS

SEQ ID NO: 5146 - protein, 4 aa, synthetic construct
IGKQ

SEQ ID NO: 5147 - protein, 4 aa, synthetic construct
QAIH

SEQ ID NO: 5148 - protein, 4 aa, synthetic construct
QHGL

SEQ ID NO: 5149 - protein, 4 aa, synthetic construct
QFMC

SEQ ID NO: 5150 - protein, 4 aa, synthetic construct
QNQM

SEQ ID NO: 5151 - protein, 4 aa, synthetic construct
QHLQ

SEQ ID NO: 5152 - protein, 4 aa, synthetic construct
QPAR

SEQ ID NO: 5153 - protein, 4 aa, synthetic construct
QSLQ

SEQ ID NO: 5154 - protein, 4 aa, synthetic construct
QSQL

SEQ ID NO: 5155 - protein, 4 aa, synthetic construct
HSQQ

SEQ ID NO: 5156 - protein, 4 aa, synthetic construct
QMPS

SEQ ID NO: 5157 - protein, 4 aa, synthetic construct
QGSL

SEQ ID NO: 5158 - protein, 4 aa, synthetic construct
QVPA

SEQ ID NO: 5159 - protein, 4 aa, synthetic construct
HYQQ

SEQ ID NO: 5160 - protein, 4 aa, synthetic construct
QVPS

SEQ ID NO: 5161 - protein, 4 aa, synthetic construct
RGEQ

SEQ ID NO: 5162 - protein, 4 aa, synthetic construct
PGQQ

SEQ ID NO: 5163 - protein, 4 aa, synthetic construct
LEQQ

SEQ ID NO: 5164 - protein, 4 aa, synthetic construct
QNQS

SEQ ID NO: 5165 - protein, 4 aa, synthetic construct
QKVI

SEQ ID NO: 5166 - protein, 4 aa, synthetic construct
QNND

SEQ ID NO: 5167 - protein, 4 aa, synthetic construct
QSVH

SEQ ID NO: 5168 - protein, 4 aa, synthetic construct
QPLG

SEQ ID NO: 5169 - protein, 4 aa, synthetic construct
HNQE

SEQ ID NO: 5170 - protein, 4 aa, synthetic construct
QIQQ

SEQ ID NO: 5171 - protein, 4 aa, synthetic construct
QVRN

SEQ ID NO: 5172 - protein, 4 aa, synthetic construct
PSNQ

SEQ ID NO: 5173 - protein, 4 aa, synthetic construct
QVGH

SEQ ID NO: 5174 - protein, 4 aa, synthetic construct
QRDI

SEQ ID NO: 5175 - protein, 4 aa, synthetic construct
QMPN

SEQ ID NO: 5176 - protein, 4 aa, synthetic construct
RGLQ

SEQ ID NO: 5177 - protein, 4 aa, synthetic construct
PSLQ

SEQ ID NO: 5178 - protein, 4 aa, synthetic construct
QRDQ

SEQ ID NO: 5179 - protein, 4 aa, synthetic construct
QAKG

SEQ ID NO: 5180 - protein, 4 aa, synthetic construct
QSAH

SEQ ID NO: 5181 - protein, 4 aa, synthetic construct
QSTM

SEQ ID NO: 5182 - protein, 4 aa, synthetic construct
QREM

SEQ ID NO: 5183 - protein, 4 aa, synthetic construct
QYRA

SEQ ID NO: 5184 - protein, 4 aa, synthetic construct
QRQQ

SEQ ID NO: 5185 - protein, 4 aa, synthetic construct
QWQQ

SEQ ID NO: 5186 - protein, 4 aa, synthetic construct
QRMN

SEQ ID NO: 5187 - protein, 4 aa, synthetic construct
GDSQ

SEQ ID NO: 5188 - protein, 4 aa, synthetic construct
QKIS

SEQ ID NO: 5189 - protein, 4 aa, synthetic construct
PSMQ

SEQ ID NO: 5190 - protein, 4 aa, synthetic construct
SPRQ

SEQ ID NO: 5191 - protein, 4 aa, synthetic construct
MEQQ

SEQ ID NO: 5192 - protein, 4 aa, synthetic construct
QYQN

SEQ ID NO: 5193 - protein, 4 aa, synthetic construct
QIRQ

SEQ ID NO: 5194 - protein, 4 aa, synthetic construct
QSVQ

SEQ ID NO: 5195 - protein, 4 aa, synthetic construct
RSQQ

SEQ ID NO: 5196 - protein, 4 aa, synthetic construct
QNKL

SEQ ID NO: 5197 - protein, 4 aa, synthetic construct
QIQH

SEQ ID NO: 5198 - protein, 4 aa, synthetic construct
PRQQ

SEQ ID NO: 5199 - protein, 4 aa, synthetic construct
HTQQ

SEQ ID NO: 5200 - protein, 4 aa, synthetic construct
QRQH

SEQ ID NO: 5201 - protein, 4 aa, synthetic construct
RNQE

SEQ ID NO: 5202 - protein, 4 aa, synthetic construct
QSKQ

SEQ ID NO: 5203 - protein, 4 aa, synthetic construct
QNQP

SEQ ID NO: 5204 - protein, 4 aa, synthetic construct
QSPQ

SEQ ID NO: 5205 - protein, 4 aa, synthetic construct
QTRQ

SEQ ID NO: 5206 - protein, 4 aa, synthetic construct
QNLH

SEQ ID NO: 5207 - protein, 4 aa, synthetic construct
QNQE

SEQ ID NO: 5208 - protein, 4 aa, synthetic construct
LNQP

SEQ ID NO: 5209 - protein, 4 aa, synthetic construct
QNQD

SEQ ID NO: 5210 - protein, 4 aa, synthetic construct
QNLL

SEQ ID NO: 5211 - protein, 4 aa, synthetic construct
QLVI

SEQ ID NO: 5212 - protein, 4 aa, synthetic construct
RTQE

SEQ ID NO: 5213 - protein, 4 aa, synthetic construct
QTHQ

SEQ ID NO: 5214 - protein, 4 aa, synthetic construct
QDQH

SEQ ID NO: 5215 - protein, 4 aa, synthetic construct
QSQH

SEQ ID NO: 5216 - protein, 4 aa, synthetic construct
VRQQ

SEQ ID NO: 5217 - protein, 4 aa, synthetic construct
AWQQ

SEQ ID NO: 5218 - protein, 4 aa, synthetic construct
QSVP

SEQ ID NO: 5219 - protein, 4 aa, synthetic construct
QNIQ

SEQ ID NO: 5220 - protein, 4 aa, synthetic construct
LDQQ

SEQ ID NO: 5221 - protein, 4 aa, synthetic construct
PDQQ

SEQ ID NO: 5222 - protein, 4 aa, synthetic construct
ESQQ

SEQ ID NO: 5223 - protein, 4 aa, synthetic construct
QRQL

SEQ ID NO: 5224 - protein, 4 aa, synthetic construct
QIIV

SEQ ID NO: 5225 - protein, 4 aa, synthetic construct
QKQS

SEQ ID NO: 5226 - protein, 4 aa, synthetic construct
QSHQ

SEQ ID NO: 5227 - protein, 4 aa, synthetic construct
QFVV

SEQ ID NO: 5228 - protein, 4 aa, synthetic construct
QSQP

SEQ ID NO: 5229 - protein, 4 aa, synthetic construct
QNEQ

SEQ ID NO: 5230 - protein, 4 aa, synthetic construct
INQQ

SEQ ID NO: 5231 - protein, 4 aa, synthetic construct
RNRQ

SEQ ID NO: 5232 - protein, 4 aa, synthetic construct
RDQK

SEQ ID NO: 5233 - protein, 4 aa, synthetic construct
QWKR

SEQ ID NO: 5234 - protein, 4 aa, synthetic construct
ENRQ

SEQ ID NO: 5235 - protein, 4 aa, synthetic construct
QTQP

SEQ ID NO: 5236 - protein, 4 aa, synthetic construct
QKQL

SEQ ID NO: 5237 - protein, 4 aa, synthetic construct
RNQL

SEQ ID NO: 5238 - protein, 4 aa, synthetic construct
ISIQ

SEQ ID NO: 5239 - protein, 4 aa, synthetic construct
QTVC

SEQ ID NO: 5240 - protein, 4 aa, synthetic construct
QQIM

SEQ ID NO: 5241 - protein, 4 aa, synthetic construct
LNHQ

SEQ ID NO: 5242 - protein, 4 aa, synthetic construct
QNQA

SEQ ID NO: 5243 - protein, 4 aa, synthetic construct
QMIH

SEQ ID NO: 5244 - protein, 4 aa, synthetic construct
RNHQ

SEQ ID NO: 5245 - protein, 4 aa, synthetic construct
QKMN

SEQ ID NO: 5246 - protein, 17 aa, synthetic construct
TINGSGSPHKYGQNQQT

SEQ ID NO: 5247 - protein, 7 aa, synthetic construct
SLLWNQQ

SEQ ID NO: 5248 - protein, 7 aa, synthetic construct
SKAQYYV

SEQ ID NO: 5249 - protein, 7 aa, synthetic construct
SKLRRQQ

SEQ ID NO: 5250 - protein, 7 aa, synthetic construct
SIWQNQQ

SEQ ID NO: 5251 - protein, 7 aa, synthetic construct
SKAGCGQ

SEQ ID NO: 5252 - protein, 7 aa, synthetic construct
SRAQNQQ

SEQ ID NO: 5253 - protein, 7 aa, synthetic construct
SKRLRQQ

SEQ ID NO: 5254 - protein, 7 aa, synthetic construct
SLRRNQQ

SEQ ID NO: 5255 - protein, 7 aa, synthetic construct
SRGRNQQ

SEQ ID NO: 5256 - protein, 7 aa, synthetic construct
SEIVNQQ

SEQ ID NO: 5257 - protein, 7 aa, synthetic construct
SSRRNQQ

SEQ ID NO: 5258 - protein, 7 aa, synthetic construct
CLLQNQQ

SEQ ID NO: 5259 - protein, 7 aa, synthetic construct
SKAFRLQ

SEQ ID NO: 5260 - protein, 7 aa, synthetic construct
CLAQNQQ

SEQ ID NO: 5261 - protein, 7 aa, synthetic construct
FLRQNQQ

SEQ ID NO: 5262 - protein, 7 aa, synthetic construct
SLRFNQQ

SEQ ID NO: 5263 - protein, 7 aa, synthetic construct
SYLRNQQ

SEQ ID NO: 5264 - protein, 7 aa, synthetic construct
CSLQNQQ

SEQ ID NO: 5265 - protein, 7 aa, synthetic construct
VLWQNQQ

SEQ ID NO: 5266 - protein, 7 aa, synthetic construct
SKWLLQQ

SEQ ID NO: 5267 - protein, 7 aa, synthetic construct
SLWSNQQ

SEQ ID NO: 5268 - protein, 7 aa, synthetic construct
SKRRLQQ

SEQ ID NO: 5269 - protein, 7 aa, synthetic construct
SVYLNQQ

SEQ ID NO: 5270 - protein, 7 aa, synthetic construct
SLWLNQQ

SEQ ID NO: 5271 - protein, 7 aa, synthetic construct
SKAQRKL

SEQ ID NO: 5272 - protein, 7 aa, synthetic construct
SKALRRQ

SEQ ID NO: 5273 - protein, 7 aa, synthetic construct
SKAQRLR

SEQ ID NO: 5274 - protein, 7 aa, synthetic construct
SKAQNQQ

SEQ ID NO: 5275 - protein, 7 aa, synthetic construct
SKAQRRL

SEQ ID NO: 5276 - protein, 7 aa, synthetic construct
SKARRQQ

SEQ ID NO: 5277 - protein, 7 aa, synthetic construct
SKARRLQ

SEQ ID NO: 5278 - protein, 7 aa, synthetic construct
SKSRRQQ

SEQ ID NO: 5279 - protein, 7 aa, synthetic construct
SKARLRQ

SEQ ID NO: 5280 - protein, 7 aa, synthetic construct
SKASKRQ

SEQ ID NO: 5281 - protein, 7 aa, synthetic construct
VRRQNQQ

SEQ ID NO: 5282 - protein, 7 aa, synthetic construct
SKAQLYR

SEQ ID NO: 5283 - protein, 7 aa, synthetic construct
SLFRNQQ

SEQ ID NO: 5284 - protein, 7 aa, synthetic construct
SKAQLTV

SEQ ID NO: 5285 - protein, 13 aa, synthetic construct
GSGSPHSLLWNQQ

SEQ ID NO: 5286 - protein, 13 aa, synthetic construct
GSGSPHSIWQNQQ

SEQ ID NO: 5287 - protein, 13 aa, synthetic construct
GSGSPHSEIVNQQ

SEQ ID NO: 5288 - protein, 13 aa, synthetic construct
GSGSPHCLLQNQQ

SEQ ID NO: 5289 - protein, 13 aa, synthetic construct
GSGSPHCLAQNQQ

SEQ ID NO: 5290 - protein, 13 aa, synthetic construct
GSGSPHSYLRNQQ

SEQ ID NO: 5291 - protein, 13 aa, synthetic construct
GSGSPHCSLQNQQ

SEQ ID NO: 5292 - protein, 13 aa, synthetic construct
GSGSPHVLWQNQQ

SEQ ID NO: 5293 - protein, 13 aa, synthetic construct
GSGSPHSLWSNQQ

SEQ ID NO: 5294 - protein, 13 aa, synthetic construct
GSGSPHSVYLNQQ

SEQ ID NO: 5295 - protein, 13 aa, synthetic construct
GSGSPHSLWLNQQ

SEQ ID NO: 5296 - protein, 13 aa, synthetic construct
GSGSPHSLFRNQQ

SEQ ID NO: 5297 - protein, 6 aa, synthetic construct
TINGHD

SEQ ID NO: 5298 - protein, 6 aa, synthetic construct
MPEGHD

SEQ ID NO: 5299 - protein, 6 aa, synthetic construct
MEGGHD

SEQ ID NO: 5300 - protein, 6 aa, synthetic construct
MEYGHD

SEQ ID NO: 5301 - protein, 6 aa, synthetic construct
AEWGHD

SEQ ID NO: 5302 - protein, 6 aa, synthetic construct
CEWGHD

SEQ ID NO: 5303 - protein, 6 aa, synthetic construct
ANNGQD

SEQ ID NO: 5304 - protein, 6 aa, synthetic construct
IPEGHD

SEQ ID NO: 5305 - protein, 6 aa, synthetic construct
ADMGHD

SEQ ID NO: 5306 - protein, 6 aa, synthetic construct
IEYGHD

SEQ ID NO: 5307 - protein, 6 aa, synthetic construct
ADYGHD

SEQ ID NO: 5308 - protein, 6 aa, synthetic construct
IETGHD

SEQ ID NO: 5309 - protein, 6 aa, synthetic construct
MEWGHD

SEQ ID NO: 5310 - protein, 6 aa, synthetic construct
CEYGHD

SEQ ID NO: 5311 - protein, 6 aa, synthetic construct
RINGHD

SEQ ID NO: 5312 - protein, 6 aa, synthetic construct
MEIGHD

SEQ ID NO: 5313 - protein, 6 aa, synthetic construct
LEYGHD

SEQ ID NO: 5314 - protein, 6 aa, synthetic construct
ADWGHD

SEQ ID NO: 5315 - protein, 6 aa, synthetic construct
IEIGHD

SEQ ID NO: 5316 - protein, 6 aa, synthetic construct
TIKDND

SEQ ID NO: 5317 - protein, 6 aa, synthetic construct
DIMGHD

SEQ ID NO: 5318 - protein, 6 aa, synthetic construct
FEQGHD

SEQ ID NO: 5319 - protein, 6 aa, synthetic construct
MEFGHD

SEQ ID NO: 5320 - protein, 6 aa, synthetic construct
CDQGHD

SEQ ID NO: 5321 - protein, 6 aa, synthetic construct
LPEGHD

SEQ ID NO: 5322 - protein, 6 aa, synthetic construct
IENGHD

SEQ ID NO: 5323 - protein, 6 aa, synthetic construct
MESGHD

SEQ ID NO: 5324 - protein, 6 aa, synthetic construct
AEIGHD

SEQ ID NO: 5325 - protein, 6 aa, synthetic construct
VEYGHD

SEQ ID NO: 5326 - protein, 6 aa, synthetic construct
TSNGDD

SEQ ID NO: 5327 - protein, 6 aa, synthetic construct
IEVGHD

SEQ ID NO: 5328 - protein, 6 aa, synthetic construct
MEMGHD

SEQ ID NO: 5329 - protein, 6 aa, synthetic construct
AEVGHD

SEQ ID NO: 5330 - protein, 6 aa, synthetic construct
MDAGHD

SEQ ID NO: 5331 - protein, 6 aa, synthetic construct
VEWGHD

SEQ ID NO: 5332 - protein, 6 aa, synthetic construct
AEQGHD

SEQ ID NO: 5333 - protein, 6 aa, synthetic construct
LEWGHD

SEQ ID NO: 5334 - protein, 6 aa, synthetic construct
MELGHD

SEQ ID NO: 5335 - protein, 6 aa, synthetic construct
METGHD

SEQ ID NO: 5336 - protein, 6 aa, synthetic construct
MEAGHD

SEQ ID NO: 5337 - protein, 6 aa, synthetic construct
TINRQR

SEQ ID NO: 5338 - protein, 6 aa, synthetic construct
IESGHD

SEQ ID NO: 5339 - protein, 6 aa, synthetic construct
TAKDHD

SEQ ID NO: 5340 - protein, 6 aa, synthetic construct
MEVGHD

SEQ ID NO: 5341 - protein, 6 aa, synthetic construct
CEIGHD

SEQ ID NO: 5342 - protein, 6 aa, synthetic construct
ATNGHD

SEQ ID NO: 5343 - protein, 6 aa, synthetic construct
MDGGHD

SEQ ID NO: 5344 - protein, 6 aa, synthetic construct
QEVGHD

SEQ ID NO: 5345 - protein, 6 aa, synthetic construct
ADQGHD

SEQ ID NO: 5346 - protein, 6 aa, synthetic construct
NMNGHD

SEQ ID NO: 5347 - protein, 6 aa, synthetic construct
TPWEHD

SEQ ID NO: 5348 - protein, 6 aa, synthetic construct
IEMGHD

SEQ ID NO: 5349 - protein, 6 aa, synthetic construct
TANEHD

SEQ ID NO: 5350 - protein, 6 aa, synthetic construct
QQQGHD

SEQ ID NO: 5351 - protein, 6 aa, synthetic construct
TPQDHD

SEQ ID NO: 5352 - protein, 6 aa, synthetic construct
HDWGHD

SEQ ID NO: 5353 - protein, 6 aa, synthetic construct
IEGGHD

SEQ ID NO: 5354 - protein, 11 aa, synthetic construct
TINGHDSPHKR

SEQ ID NO: 5355 - protein, 11 aa, synthetic construct
MPEGHDSPHKS

SEQ ID NO: 5356 - protein, 11 aa, synthetic construct
MEGGHDSPHKS

SEQ ID NO: 5357 - protein, 11 aa, synthetic construct
MEYGHDSPHKS

SEQ ID NO: 5358 - protein, 11 aa, synthetic construct
AEWGHDSPHKS

SEQ ID NO: 5359 - protein, 11 aa, synthetic construct
CEWGHDSPHKS

SEQ ID NO: 5360 - protein, 11 aa, synthetic construct
ANNGQDSPHKS

SEQ ID NO: 5361 - protein, 11 aa, synthetic construct
IPEGHDSPHKS

SEQ ID NO: 5362 - protein, 11 aa, synthetic construct
ADMGHDSPHKS

SEQ ID NO: 5363 - protein, 11 aa, synthetic construct
IEYGHDSPHKS

SEQ ID NO: 5364 - protein, 11 aa, synthetic construct
ADYGHDSPHKS

SEQ ID NO: 5365 - protein, 11 aa, synthetic construct
IETGHDSPHKS

SEQ ID NO: 5366 - protein, 11 aa, synthetic construct
MEWGHDSPHKS

SEQ ID NO: 5367 - protein, 11 aa, synthetic construct
CEYGHDSPHKS

SEQ ID NO: 5368 - protein, 11 aa, synthetic construct
RINGHDSPHKS

SEQ ID NO: 5369 - protein, 11 aa, synthetic construct
MEIGHDSPHKS

SEQ ID NO: 5370 - protein, 11 aa, synthetic construct
LEYGHDSPHKS

SEQ ID NO: 5371 - protein, 11 aa, synthetic construct
ADWGHDSPHKS

SEQ ID NO: 5372 - protein, 11 aa, synthetic construct
IEIGHDSPHKS

SEQ ID NO: 5373 - protein, 11 aa, synthetic construct
TIKDNDSPHKS

SEQ ID NO: 5374 - protein, 11 aa, synthetic construct
DIMGHDSPHKS

SEQ ID NO: 5375 - protein, 11 aa, synthetic construct
FEQGHDSPHKS

SEQ ID NO: 5376 - protein, 11 aa, synthetic construct
MEFGHDSPHKS

SEQ ID NO: 5377 - protein, 11 aa, synthetic construct
CDQGHDSPHKS

SEQ ID NO: 5378 - protein, 11 aa, synthetic construct
LPEGHDSPHKS

SEQ ID NO: 5379 - protein, 11 aa, synthetic construct
IENGHDSPHKS

SEQ ID NO: 5380 - protein, 11 aa, synthetic construct
MESGHDSPHKS

SEQ ID NO: 5381 - protein, 11 aa, synthetic construct
AEIGHDSPHKS

SEQ ID NO: 5382 - protein, 11 aa, synthetic construct
VEYGHDSPHKS

SEQ ID NO: 5383 - protein, 11 aa, synthetic construct
TSNGDDSPHKS

SEQ ID NO: 5384 - protein, 11 aa, synthetic construct
IEVGHDSPHKS

SEQ ID NO: 5385 - protein, 11 aa, synthetic construct
MEMGHDSPHKS

SEQ ID NO: 5386 - protein, 11 aa, synthetic construct
AEVGHDSPHKS

SEQ ID NO: 5387 - protein, 11 aa, synthetic construct
MDAGHDSPHKS

SEQ ID NO: 5388 - protein, 11 aa, synthetic construct
VEWGHDSPHKS

SEQ ID NO: 5389 - protein, 11 aa, synthetic construct
AEQGHDSPHKS

SEQ ID NO: 5390 - protein, 11 aa, synthetic construct
LEWGHDSPHKS

SEQ ID NO: 5391 - protein, 11 aa, synthetic construct
MELGHDSPHKS

SEQ ID NO: 5392 - protein, 11 aa, synthetic construct
METGHDSPHKS

SEQ ID NO: 5393 - protein, 11 aa, synthetic construct
MEAGHDSPHKS

SEQ ID NO: 5394 - protein, 11 aa, synthetic construct
TINRQRSPHKS

SEQ ID NO: 5395 - protein, 11 aa, synthetic construct
IESGHDSPHKS

SEQ ID NO: 5396 - protein, 11 aa, synthetic construct
TAKDHDSPHKS

SEQ ID NO: 5397 - protein, 11 aa, synthetic construct
MEVGHDSPHKS

SEQ ID NO: 5398 - protein, 11 aa, synthetic construct
CEIGHDSPHKS

SEQ ID NO: 5399 - protein, 11 aa, synthetic construct
ATNGHDSPHKS

SEQ ID NO: 5400 - protein, 11 aa, synthetic construct
MDGGHDSPHKS

SEQ ID NO: 5401 - protein, 11 aa, synthetic construct
QEVGHDSPHKS

SEQ ID NO: 5402 - protein, 11 aa, synthetic construct
ADQGHDSPHKS

SEQ ID NO: 5403 - protein, 11 aa, synthetic construct
NMNGHDSPHKS

SEQ ID NO: 5404 - protein, 11 aa, synthetic construct
TPWEHDSPHKS

SEQ ID NO: 5405 - protein, 11 aa, synthetic construct
IEMGHDSPHKS

SEQ ID NO: 5406 - protein, 11 aa, synthetic construct
TANEHDSPHKS

SEQ ID NO: 5407 - protein, 11 aa, synthetic construct
TINGHDSPHKS

SEQ ID NO: 5408 - protein, 11 aa, synthetic construct
QQQGHDSPHKS

SEQ ID NO: 5409 - protein, 11 aa, synthetic construct
TPQDHDSPHKS

SEQ ID NO: 5410 - protein, 11 aa, synthetic construct
HDWGHDSPHKS

SEQ ID NO: 5411 - protein, 11 aa, synthetic construct
IEGGHDSPHKS

SEQ ID NO: 5412 - protein, 5 aa, synthetic construct
QNQQT

SEQ ID NO: 5413 - protein, 5 aa, synthetic construct
QNRHT

SEQ ID NO: 5414 - protein, 5 aa, synthetic construct
RDQQT

SEQ ID NO: 5415 - protein, 5 aa, synthetic construct
PNLQT

SEQ ID NO: 5416 - protein, 5 aa, synthetic construct
HVRQT

SEQ ID NO: 5417 - protein, 5 aa, synthetic construct
PNQHT

SEQ ID NO: 5418 - protein, 5 aa, synthetic construct
QSQQT

SEQ ID NO: 5419 - protein, 5 aa, synthetic construct
QNQQI

SEQ ID NO: 5420 - protein, 5 aa, synthetic construct
QPAKT

SEQ ID NO: 5421 - protein, 5 aa, synthetic construct
QTQQN

SEQ ID NO: 5422 - protein, 5 aa, synthetic construct
QNLAT

SEQ ID NO: 5423 - protein, 5 aa, synthetic construct
QNQLT

SEQ ID NO: 5424 - protein, 5 aa, synthetic construct
QGQQT

SEQ ID NO: 5425 - protein, 5 aa, synthetic construct
LNRQS

SEQ ID NO: 5426 - protein, 5 aa, synthetic construct
HNQQT

SEQ ID NO: 5427 - protein, 5 aa, synthetic construct
QNPPT

SEQ ID NO: 5428 - protein, 5 aa, synthetic construct
QNLQT

SEQ ID NO: 5429 - protein, 5 aa, synthetic construct
QYQQT

SEQ ID NO: 5430 - protein, 5 aa, synthetic construct
QDQET

SEQ ID NO: 5431 - protein, 5 aa, synthetic construct
QNHQT

SEQ ID NO: 5432 - protein, 5 aa, synthetic construct
QDQQT

SEQ ID NO: 5433 - protein, 5 aa, synthetic construct
HWQQT

SEQ ID NO: 5434 - protein, 5 aa, synthetic construct
PNQQT

SEQ ID NO: 5435 - protein, 5 aa, synthetic construct
QNQLI

SEQ ID NO: 5436 - protein, 5 aa, synthetic construct
PEQQT

SEQ ID NO: 5437 - protein, 5 aa, synthetic construct
QRTMT

SEQ ID NO: 5438 - protein, 5 aa, synthetic construct
QNQQH

SEQ ID NO: 5439 - protein, 5 aa, synthetic construct
LHQHT

SEQ ID NO: 5440 - protein, 5 aa, synthetic construct
QHRIT

SEQ ID NO: 5441 - protein, 5 aa, synthetic construct
QYIHT

SEQ ID NO: 5442 - protein, 5 aa, synthetic construct
QKFET

SEQ ID NO: 5443 - protein, 5 aa, synthetic construct
QFPST

SEQ ID NO: 5444 - protein, 5 aa, synthetic construct
HNQQR

SEQ ID NO: 5445 - protein, 5 aa, synthetic construct
QAIKT

SEQ ID NO: 5446 - protein, 5 aa, synthetic construct
QNRQT

SEQ ID NO: 5447 - protein, 5 aa, synthetic construct
QYQHT

SEQ ID NO: 5448 - protein, 5 aa, synthetic construct
QNPQS

SEQ ID NO: 5449 - protein, 5 aa, synthetic construct
QHQLT

SEQ ID NO: 5450 - protein, 5 aa, synthetic construct
QSPPT

SEQ ID NO: 5451 - protein, 5 aa, synthetic construct
QAKLT

SEQ ID NO: 5452 - protein, 5 aa, synthetic construct
KSQQT

SEQ ID NO: 5453 - protein, 5 aa, synthetic construct
QDRPT

SEQ ID NO: 5454 - protein, 5 aa, synthetic construct
QSQQL

SEQ ID NO: 5455 - protein, 5 aa, synthetic construct
QAFHT

SEQ ID NO: 5456 - protein, 5 aa, synthetic construct
QKQQD

SEQ ID NO: 5457 - protein, 5 aa, synthetic construct
QNAQT

SEQ ID NO: 5458 - protein, 5 aa, synthetic construct
HNQLT

SEQ ID NO: 5459 - protein, 5 aa, synthetic construct
QNQQY

SEQ ID NO: 5460 - protein, 5 aa, synthetic construct
QKLNT

SEQ ID NO: 5461 - protein, 5 aa, synthetic construct
QNVQT

SEQ ID NO: 5462 - protein, 5 aa, synthetic construct
QAQQT

SEQ ID NO: 5463 - protein, 5 aa, synthetic construct
QNLQA

SEQ ID NO: 5464 - protein, 5 aa, synthetic construct
QTPPT

SEQ ID NO: 5465 - protein, 5 aa, synthetic construct
QYQHA

SEQ ID NO: 5466 - protein, 5 aa, synthetic construct
QGQQA

SEQ ID NO: 5467 - protein, 5 aa, synthetic construct
QPPAT

SEQ ID NO: 5468 - protein, 5 aa, synthetic construct
QERPT

SEQ ID NO: 5469 - protein, 5 aa, synthetic construct
QDLQT

SEQ ID NO: 5470 - protein, 5 aa, synthetic construct
QAMHT

SEQ ID NO: 5471 - protein, 5 aa, synthetic construct
LNQQT

SEQ ID NO: 5472 - protein, 5 aa, synthetic construct
QHPST

SEQ ID NO: 5473 - protein, 5 aa, synthetic construct
PGLQT

SEQ ID NO: 5474 - protein, 5 aa, synthetic construct
QGIRT

SEQ ID NO: 5475 - protein, 5 aa, synthetic construct
QAPAT

SEQ ID NO: 5476 - protein, 5 aa, synthetic construct
QSQQI

SEQ ID NO: 5477 - protein, 5 aa, synthetic construct
QIPPT

SEQ ID NO: 5478 - protein, 5 aa, synthetic construct
QTQLT

SEQ ID NO: 5479 - protein, 5 aa, synthetic construct
QAPST

SEQ ID NO: 5480 - protein, 5 aa, synthetic construct
QNTYA

SEQ ID NO: 5481 - protein, 5 aa, synthetic construct
QNQHI

SEQ ID NO: 5482 - protein, 5 aa, synthetic construct
QNHLT

SEQ ID NO: 5483 - protein, 5 aa, synthetic construct
QIGMT

SEQ ID NO: 5484 - protein, 5 aa, synthetic construct
LNKQT

SEQ ID NO: 5485 - protein, 5 aa, synthetic construct
QLQQT

SEQ ID NO: 5486 - protein, 5 aa, synthetic construct
QRMST

SEQ ID NO: 5487 - protein, 5 aa, synthetic construct
QGILT

SEQ ID NO: 5488 - protein, 5 aa, synthetic construct
QDRQT

SEQ ID NO: 5489 - protein, 5 aa, synthetic construct
RDWQT

SEQ ID NO: 5490 - protein, 5 aa, synthetic construct
QNTHD

SEQ ID NO: 5491 - protein, 5 aa, synthetic construct
PNLQI

SEQ ID NO: 5492 - protein, 5 aa, synthetic construct
QERST

SEQ ID NO: 5493 - protein, 5 aa, synthetic construct
QNYQT

SEQ ID NO: 5494 - protein, 5 aa, synthetic construct
QRTCT

SEQ ID NO: 5495 - protein, 5 aa, synthetic construct
QIGHT

SEQ ID NO: 5496 - protein, 5 aa, synthetic construct
QGAIT

SEQ ID NO: 5497 - protein, 5 aa, synthetic construct
QVPPT

SEQ ID NO: 5498 - protein, 5 aa, synthetic construct
QVQQI

SEQ ID NO: 5499 - protein, 5 aa, synthetic construct
LMRQT

SEQ ID NO: 5500 - protein, 5 aa, synthetic construct
QYSVT

SEQ ID NO: 5501 - protein, 5 aa, synthetic construct
QAITT

SEQ ID NO: 5502 - protein, 5 aa, synthetic construct
QKTLT

SEQ ID NO: 5503 - protein, 5 aa, synthetic construct
QNQWT

SEQ ID NO: 5504 - protein, 5 aa, synthetic construct
QLHHT

SEQ ID NO: 5505 - protein, 5 aa, synthetic construct
QNIII

SEQ ID NO: 5506 - protein, 5 aa, synthetic construct
QGHHT

SEQ ID NO: 5507 - protein, 5 aa, synthetic construct
QSKVT

SEQ ID NO: 5508 - protein, 5 aa, synthetic construct
QLPST

SEQ ID NO: 5509 - protein, 5 aa, synthetic construct
IGKQT

SEQ ID NO: 5510 - protein, 5 aa, synthetic construct
QAIHT

SEQ ID NO: 5511 - protein, 5 aa, synthetic construct
QHGLT

SEQ ID NO: 5512 - protein, 5 aa, synthetic construct
QFMCT

SEQ ID NO: 5513 - protein, 5 aa, synthetic construct
QHLQT

SEQ ID NO: 5514 - protein, 5 aa, synthetic construct
QNHQN

SEQ ID NO: 5515 - protein, 5 aa, synthetic construct
QPART

SEQ ID NO: 5516 - protein, 5 aa, synthetic construct
QSLQT

SEQ ID NO: 5517 - protein, 5 aa, synthetic construct
QSQLT

SEQ ID NO: 5518 - protein, 5 aa, synthetic construct
QDRQS

SEQ ID NO: 5519 - protein, 5 aa, synthetic construct
QMPST

SEQ ID NO: 5520 - protein, 5 aa, synthetic construct
QGSLT

SEQ ID NO: 5521 - protein, 5 aa, synthetic construct
QVPAT

SEQ ID NO: 5522 - protein, 5 aa, synthetic construct
QDKQT

SEQ ID NO: 5523 - protein, 5 aa, synthetic construct
HYQQT

SEQ ID NO: 5524 - protein, 5 aa, synthetic construct
QVPST

SEQ ID NO: 5525 - protein, 5 aa, synthetic construct
RGEQT

SEQ ID NO: 5526 - protein, 5 aa, synthetic construct
PGQQT

SEQ ID NO: 5527 - protein, 5 aa, synthetic construct
QSLQI

SEQ ID NO: 5528 - protein, 5 aa, synthetic construct
LEQQT

SEQ ID NO: 5529 - protein, 5 aa, synthetic construct
QNQST

SEQ ID NO: 5530 - protein, 5 aa, synthetic construct
QKVIT

SEQ ID NO: 5531 - protein, 5 aa, synthetic construct
QNNDQ

SEQ ID NO: 5532 - protein, 5 aa, synthetic construct
QSVHT

SEQ ID NO: 5533 - protein, 5 aa, synthetic construct
QPLGT

SEQ ID NO: 5534 - protein, 5 aa, synthetic construct
HNQET

SEQ ID NO: 5535 - protein, 5 aa, synthetic construct
QNLQI

SEQ ID NO: 5536 - protein, 5 aa, synthetic construct
QIQQT

SEQ ID NO: 5537 - protein, 5 aa, synthetic construct
QVRNT

SEQ ID NO: 5538 - protein, 5 aa, synthetic construct
PSNQT

SEQ ID NO: 5539 - protein, 5 aa, synthetic construct
QVGHT

SEQ ID NO: 5540 - protein, 5 aa, synthetic construct
QRDIT

SEQ ID NO: 5541 - protein, 5 aa, synthetic construct
QMPNT

SEQ ID NO: 5542 - protein, 5 aa, synthetic construct
RGLQT

SEQ ID NO: 5543 - protein, 5 aa, synthetic construct
QKQQT

SEQ ID NO: 5544 - protein, 5 aa, synthetic construct
PSLQT

SEQ ID NO: 5545 - protein, 5 aa, synthetic construct
QRDQT

SEQ ID NO: 5546 - protein, 5 aa, synthetic construct
QAKGT

SEQ ID NO: 5547 - protein, 5 aa, synthetic construct
QSAHT

SEQ ID NO: 5548 - protein, 5 aa, synthetic construct
QSTMT

SEQ ID NO: 5549 - protein, 5 aa, synthetic construct
QREMT

SEQ ID NO: 5550 - protein, 5 aa, synthetic construct
QYRAT

SEQ ID NO: 5551 - protein, 5 aa, synthetic construct
QWQQT

SEQ ID NO: 5552 - protein, 5 aa, synthetic construct
QRMNT

SEQ ID NO: 5553 - protein, 5 aa, synthetic construct
GDSQT

SEQ ID NO: 5554 - protein, 5 aa, synthetic construct
QKIST

SEQ ID NO: 5555 - protein, 5 aa, synthetic construct
PSMQT

SEQ ID NO: 5556 - protein, 5 aa, synthetic construct
SPRQT

SEQ ID NO: 5557 - protein, 5 aa, synthetic construct
MEQQT

SEQ ID NO: 5558 - protein, 5 aa, synthetic construct
QYQNT

SEQ ID NO: 5559 - protein, 5 aa, synthetic construct
QHQQT

SEQ ID NO: 5560 - protein, 5 aa, synthetic construct
INQQT

SEQ ID NO: 5561 - protein, 5 aa, synthetic construct
PNQQH

SEQ ID NO: 5562 - protein, 5 aa, synthetic construct
ENRQT

SEQ ID NO: 5563 - protein, 5 aa, synthetic construct
QTQQA

SEQ ID NO: 5564 - protein, 5 aa, synthetic construct
QNQAT

SEQ ID NO: 5565 - protein, 4 aa, synthetic construct
KTII

SEQ ID NO: 5566 - protein, 4 aa, synthetic construct
KTFP

SEQ ID NO: 5567 - protein, 4 aa, synthetic construct
KTEK

SEQ ID NO: 5568 - protein, 4 aa, synthetic construct
KTVN

SEQ ID NO: 5569 - protein, 4 aa, synthetic construct
KTFN

SEQ ID NO: 5570 - protein, 4 aa, synthetic construct
KTIN

SEQ ID NO: 5571 - protein, 4 aa, synthetic construct
TTIN

SEQ ID NO: 5572 - protein, 4 aa, synthetic construct
KSIN

SEQ ID NO: 5573 - protein, 4 aa, synthetic construct
KTER

SEQ ID NO: 5574 - protein, 4 aa, synthetic construct
KELH

SEQ ID NO: 5575 - protein, 4 aa, synthetic construct
KAIN

SEQ ID NO: 5576 - protein, 4 aa, synthetic construct
KTDN

SEQ ID NO: 5577 - protein, 4 aa, synthetic construct
KTFH

SEQ ID NO: 5578 - protein, 4 aa, synthetic construct
KTSN

SEQ ID NO: 5579 - protein, 4 aa, synthetic construct
ETIN

SEQ ID NO: 5580 - protein, 4 aa, synthetic construct
NTIN

SEQ ID NO: 5581 - protein, 4 aa, synthetic construct
KTEN

SEQ ID NO: 5582 - protein, 4 aa, synthetic construct
KTSS

SEQ ID NO: 5583 - protein, 4 aa, synthetic construct
KTCN

SEQ ID NO: 5584 - protein, 4 aa, synthetic construct
KTEH

SEQ ID NO: 5585 - protein, 4 aa, synthetic construct
KAEM

SEQ ID NO: 5586 - protein, 4 aa, synthetic construct
KATN

SEQ ID NO: 5587 - protein, 4 aa, synthetic construct
KAIK

SEQ ID NO: 5588 - protein, 4 aa, synthetic construct
KTDK

SEQ ID NO: 5589 - protein, 4 aa, synthetic construct
KTFK

SEQ ID NO: 5590 - protein, 4 aa, synthetic construct
KSDQ

SEQ ID NO: 5591 - protein, 4 aa, synthetic construct
KTEI

SEQ ID NO: 5592 - protein, 4 aa, synthetic construct
KTID

SEQ ID NO: 5593 - protein, 4 aa, synthetic construct
KNTN

SEQ ID NO: 5594 - protein, 4 aa, synthetic construct
KTET

SEQ ID NO: 5595 - protein, 4 aa, synthetic construct
KTEL

SEQ ID NO: 5596 - protein, 4 aa, synthetic construct
KNIN

SEQ ID NO: 5597 - protein, 4 aa, synthetic construct
KTEA

SEQ ID NO: 5598 - protein, 4 aa, synthetic construct
KTAN

SEQ ID NO: 5599 - protein, 4 aa, synthetic construct
NTIY

SEQ ID NO: 5600 - protein, 4 aa, synthetic construct
KTFS

SEQ ID NO: 5601 - protein, 4 aa, synthetic construct
KTES

SEQ ID NO: 5602 - protein, 4 aa, synthetic construct
KTTN

SEQ ID NO: 5603 - protein, 4 aa, synthetic construct
KTED

SEQ ID NO: 5604 - protein, 4 aa, synthetic construct
KTNN

SEQ ID NO: 5605 - protein, 4 aa, synthetic construct
KEVH

SEQ ID NO: 5606 - protein, 4 aa, synthetic construct
KTIS

SEQ ID NO: 5607 - protein, 4 aa, synthetic construct
KTVR

SEQ ID NO: 5608 - protein, 4 aa, synthetic construct
KTDR

SEQ ID NO: 5609 - protein, 4 aa, synthetic construct
ETIK

SEQ ID NO: 5610 - protein, 4 aa, synthetic construct
KNHI

SEQ ID NO: 5611 - protein, 4 aa, synthetic construct
KESD

SEQ ID NO: 5612 - protein, 4 aa, synthetic construct
KTIK

SEQ ID NO: 5613 - protein, 4 aa, synthetic construct
KTDL

SEQ ID NO: 5614 - protein, 4 aa, synthetic construct
KTVP

SEQ ID NO: 5615 - protein, 4 aa, synthetic construct
KTVI

SEQ ID NO: 5616 - protein, 4 aa, synthetic construct
KAEH

SEQ ID NO: 5617 - protein, 4 aa, synthetic construct
KNCL

SEQ ID NO: 5618 - protein, 4 aa, synthetic construct
KTVK

SEQ ID NO: 5619 - protein, 4 aa, synthetic construct
KNAD

SEQ ID NO: 5620 - protein, 4 aa, synthetic construct
KTIT

SEQ ID NO: 5621 - protein, 4 aa, synthetic construct
KNCV

SEQ ID NO: 5622 - protein, 4 aa, synthetic construct
KNAL

SEQ ID NO: 5623 - protein, 4 aa, synthetic construct
KVIN

SEQ ID NO: 5624 - protein, 4 aa, synthetic construct
KTEF

SEQ ID NO: 5625 - protein, 4 aa, synthetic construct
KTRE

SEQ ID NO: 5626 - protein, 4 aa, synthetic construct
KQGE

SEQ ID NO: 5627 - protein, 4 aa, synthetic construct
KSEK

SEQ ID NO: 5628 - protein, 4 aa, synthetic construct
KNVN

SEQ ID NO: 5629 - protein, 4 aa, synthetic construct
KGGE

SEQ ID NO: 5630 - protein, 4 aa, synthetic construct
KEFV

SEQ ID NO: 5631 - protein, 4 aa, synthetic construct
KSDK

SEQ ID NO: 5632 - protein, 4 aa, synthetic construct
KTEQ

SEQ ID NO: 5633 - protein, 4 aa, synthetic construct
KEVQ

SEQ ID NO: 5634 - protein, 4 aa, synthetic construct
KTEY

SEQ ID NO: 5635 - protein, 4 aa, synthetic construct
KNCW

SEQ ID NO: 5636 - protein, 4 aa, synthetic construct
KTDV

SEQ ID NO: 5637 - protein, 4 aa, synthetic construct
KSDI

SEQ ID NO: 5638 - protein, 4 aa, synthetic construct
KNSI

SEQ ID NO: 5639 - protein, 4 aa, synthetic construct
KNSL

SEQ ID NO: 5640 - protein, 4 aa, synthetic construct
KEVV

SEQ ID NO: 5641 - protein, 4 aa, synthetic construct
KTEP

SEQ ID NO: 5642 - protein, 4 aa, synthetic construct
KSEL

SEQ ID NO: 5643 - protein, 4 aa, synthetic construct
KTWQ

SEQ ID NO: 5644 - protein, 4 aa, synthetic construct
KTEV

SEQ ID NO: 5645 - protein, 4 aa, synthetic construct
KAVN

SEQ ID NO: 5646 - protein, 4 aa, synthetic construct
KGVL

SEQ ID NO: 5647 - protein, 4 aa, synthetic construct
KTEG

SEQ ID NO: 5648 - protein, 4 aa, synthetic construct
KTRD

SEQ ID NO: 5649 - protein, 4 aa, synthetic construct
KTGN

SEQ ID NO: 5650 - protein, 4 aa, synthetic construct
KNAI

SEQ ID NO: 5651 - protein, 4 aa, synthetic construct
KAEN

SEQ ID NO: 5652 - protein, 4 aa, synthetic construct
KAET

SEQ ID NO: 5653 - protein, 4 aa, synthetic construct
KTVH

SEQ ID NO: 5654 - protein, 4 aa, synthetic construct
KETA

SEQ ID NO: 5655 - protein, 4 aa, synthetic construct
KNNL

SEQ ID NO: 5656 - protein, 4 aa, synthetic construct
EAIN

SEQ ID NO: 5657 - protein, 4 aa, synthetic construct
KSLN

SEQ ID NO: 5658 - protein, 4 aa, synthetic construct
KTIP

SEQ ID NO: 5659 - protein, 4 aa, synthetic construct
KTIH

SEQ ID NO: 5660 - protein, 18 aa, synthetic construct
KTINGSGSPHSKAQNQQT

SEQ ID NO: 5661 - protein, 5 aa, synthetic construct
NPHKS

SEQ ID NO: 5662 - protein, 6 aa, synthetic construct
NPHKSG

SEQ ID NO: 5663 - protein, 6 aa, synthetic construct
SPHKIV

SEQ ID NO: 5664 - protein, 6 aa, synthetic construct
GHDNPH

SEQ ID NO: 5665 - protein, 6 aa, synthetic construct
AHDSPH

SEQ ID NO: 5666 - protein, 6 aa, synthetic construct
KHDSPH

SEQ ID NO: 5667 - protein, 6 aa, synthetic construct
WHDSPH

SEQ ID NO: 5668 - protein, 6 aa, synthetic construct
RHDSPH

SEQ ID NO: 5669 - protein, 6 aa, synthetic construct
LHDSPH

SEQ ID NO: 5670 - protein, 6 aa, synthetic construct
IHDSPH

SEQ ID NO: 5671 - protein, 6 aa, synthetic construct
MHDSPH

SEQ ID NO: 5672 - protein, 6 aa, synthetic construct
NHDSPH

SEQ ID NO: 5673 - protein, 6 aa, synthetic construct
THDSPH

SEQ ID NO: 5674 - protein, 6 aa, synthetic construct
EHDSPH

SEQ ID NO: 5675 - protein, 6 aa, synthetic construct
QHDSPH

SEQ ID NO: 5676 - protein, 6 aa, synthetic construct
YHDSPH

SEQ ID NO: 5677 - protein, 6 aa, synthetic construct
HHDSPH

SEQ ID NO: 5678 - protein, 6 aa, synthetic construct
FHDSPH

SEQ ID NO: 5679 - protein, 6 aa, synthetic construct
VHDSPH

SEQ ID NO: 5680 - protein, 9 aa, synthetic construct
GHDNPHKSG

SEQ ID NO: 5681 - protein, 9 aa, synthetic construct
AHDSPHKSG

SEQ ID NO: 5682 - protein, 9 aa, synthetic construct
AHDSPHKIG

SEQ ID NO: 5683 - protein, 9 aa, synthetic construct
KHDSPHKSG

SEQ ID NO: 5684 - protein, 9 aa, synthetic construct
WHDSPHKSG

SEQ ID NO: 5685 - protein, 9 aa, synthetic construct
RHDSPHKSG

SEQ ID NO: 5686 - protein, 9 aa, synthetic construct
LHDSPHKSG

SEQ ID NO: 5687 - protein, 9 aa, synthetic construct
IHDSPHKSG

SEQ ID NO: 5688 - protein, 9 aa, synthetic construct
MHDSPHKSG

SEQ ID NO: 5689 - protein, 9 aa, synthetic construct
NHDSPHKSG

SEQ ID NO: 5690 - protein, 9 aa, synthetic construct
THDSPHKSG

SEQ ID NO: 5691 - protein, 9 aa, synthetic construct
EHDSPHKSG

SEQ ID NO: 5692 - protein, 9 aa, synthetic construct
QHDSPHKSG

SEQ ID NO: 5693 - protein, 9 aa, synthetic construct
RHDSPHKIV

SEQ ID NO: 5694 - protein, 9 aa, synthetic construct
YHDSPHKSG

SEQ ID NO: 5695 - protein, 9 aa, synthetic construct
HHDSPHKSG

SEQ ID NO: 5696 - protein, 9 aa, synthetic construct
FHDSPHKSG

SEQ ID NO: 5697 - protein, 9 aa, synthetic construct
VHDSPHKSG

SEQ ID NO: 5698 - protein, 5 aa, synthetic construct
QIRQT

SEQ ID NO: 5699 - protein, 5 aa, synthetic construct
QNQHA

SEQ ID NO: 5700 - protein, 5 aa, synthetic construct
QSVQT

SEQ ID NO: 5701 - protein, 5 aa, synthetic construct
RSQQT

SEQ ID NO: 5702 - protein, 5 aa, synthetic construct
QNKLE

SEQ ID NO: 5703 - protein, 5 aa, synthetic construct
QNQQK

SEQ ID NO: 5704 - protein, 5 aa, synthetic construct
QHQQA

SEQ ID NO: 5705 - protein, 5 aa, synthetic construct
QIQHT

SEQ ID NO: 5706 - protein, 5 aa, synthetic construct
PRQQT

SEQ ID NO: 5707 - protein, 5 aa, synthetic construct
HTQQT

SEQ ID NO: 5708 - protein, 5 aa, synthetic construct
QRQHT

SEQ ID NO: 5709 - protein, 5 aa, synthetic construct
QNQQS

SEQ ID NO: 5710 - protein, 5 aa, synthetic construct
RNQET

SEQ ID NO: 5711 - protein, 5 aa, synthetic construct
KNQQT

SEQ ID NO: 5712 - protein, 5 aa, synthetic construct
QTQQT

SEQ ID NO: 5713 - protein, 5 aa, synthetic construct
QTQQI

SEQ ID NO: 5714 - protein, 5 aa, synthetic construct
QSKQA

SEQ ID NO: 5715 - protein, 5 aa, synthetic construct
QNQPP

SEQ ID NO: 5716 - protein, 5 aa, synthetic construct
QSPQT

SEQ ID NO: 5717 - protein, 5 aa, synthetic construct
QNQQG

SEQ ID NO: 5718 - protein, 5 aa, synthetic construct
QNQHT

SEQ ID NO: 5719 - protein, 5 aa, synthetic construct
QTRQT

SEQ ID NO: 5720 - protein, 5 aa, synthetic construct
QNLHT

SEQ ID NO: 5721 - protein, 5 aa, synthetic construct
QNQET

SEQ ID NO: 5722 - protein, 5 aa, synthetic construct
LNQPT

SEQ ID NO: 5723 - protein, 5 aa, synthetic construct
QNQDT

SEQ ID NO: 5724 - protein, 5 aa, synthetic construct
RNQQT

SEQ ID NO: 5725 - protein, 5 aa, synthetic construct
QNLLT

SEQ ID NO: 5726 - protein, 5 aa, synthetic construct
QLVIT

SEQ ID NO: 5727 - protein, 5 aa, synthetic construct
RTQET

SEQ ID NO: 5728 - protein, 5 aa, synthetic construct
QTHQT

SEQ ID NO: 5729 - protein, 5 aa, synthetic construct
QNQPA

SEQ ID NO: 5730 - protein, 5 aa, synthetic construct
QDQHT

SEQ ID NO: 5731 - protein, 5 aa, synthetic construct
QSQHT

SEQ ID NO: 5732 - protein, 5 aa, synthetic construct
RNQQI

SEQ ID NO: 5733 - protein, 5 aa, synthetic construct
VRQQT

SEQ ID NO: 5734 - protein, 5 aa, synthetic construct
QNQHS

SEQ ID NO: 5735 - protein, 5 aa, synthetic construct
AWQQT

SEQ ID NO: 5736 - protein, 5 aa, synthetic construct
QSVPT

SEQ ID NO: 5737 - protein, 5 aa, synthetic construct
QNIQP

SEQ ID NO: 5738 - protein, 5 aa, synthetic construct
QNHLN

SEQ ID NO: 5739 - protein, 5 aa, synthetic construct
LDQQT

SEQ ID NO: 5740 - protein, 5 aa, synthetic construct
PDQQS

SEQ ID NO: 5741 - protein, 5 aa, synthetic construct
ESQQT

SEQ ID NO: 5742 - protein, 5 aa, synthetic construct
QNKQT

SEQ ID NO: 5743 - protein, 5 aa, synthetic construct
QRQLT

SEQ ID NO: 5744 - protein, 5 aa, synthetic construct
QIIVT

SEQ ID NO: 5745 - protein, 5 aa, synthetic construct
QKQST

SEQ ID NO: 5746 - protein, 5 aa, synthetic construct
QSHQT

SEQ ID NO: 5747 - protein, 5 aa, synthetic construct
QFVVT

SEQ ID NO: 5748 - protein, 5 aa, synthetic construct
QSQPT

SEQ ID NO: 5749 - protein, 5 aa, synthetic construct
QNEQT

SEQ ID NO: 5750 - protein, 5 aa, synthetic construct
RNRQT

SEQ ID NO: 5751 - protein, 5 aa, synthetic construct
QSKQT

SEQ ID NO: 5752 - protein, 5 aa, synthetic construct
QNPLT

SEQ ID NO: 5753 - protein, 5 aa, synthetic construct
RDQKT

SEQ ID NO: 5754 - protein, 5 aa, synthetic construct
HNQQN

SEQ ID NO: 5755 - protein, 5 aa, synthetic construct
QWKRT

SEQ ID NO: 5756 - protein, 5 aa, synthetic construct
QNHQI

SEQ ID NO: 5757 - protein, 5 aa, synthetic construct
QNQQA

SEQ ID NO: 5758 - protein, 5 aa, synthetic construct
QNQLN

SEQ ID NO: 5759 - protein, 5 aa, synthetic construct
QTQPT

SEQ ID NO: 5760 - protein, 5 aa, synthetic construct
QKQLT

SEQ ID NO: 5761 - protein, 5 aa, synthetic construct
RNQLA

SEQ ID NO: 5762 - protein, 5 aa, synthetic construct
RNQQS

SEQ ID NO: 5763 - protein, 5 aa, synthetic construct
ISIQT

SEQ ID NO: 5764 - protein, 5 aa, synthetic construct
QNQQN

SEQ ID NO: 5765 - protein, 5 aa, synthetic construct
QSQQS

SEQ ID NO: 5766 - protein, 5 aa, synthetic construct
QTVCT

SEQ ID NO: 5767 - protein, 5 aa, synthetic construct
QYQQI

SEQ ID NO: 5768 - protein, 5 aa, synthetic construct
QQIMT

SEQ ID NO: 5769 - protein, 5 aa, synthetic construct
QNEQS

SEQ ID NO: 5770 - protein, 5 aa, synthetic construct
LNHQT

SEQ ID NO: 5771 - protein, 5 aa, synthetic construct
QMIHT

SEQ ID NO: 5772 - protein, 5 aa, synthetic construct
RNHQS

SEQ ID NO: 5773 - protein, 5 aa, synthetic construct
QKMNT

SEQ ID NO: 5774 - protein, 5 aa, synthetic construct
QSQQN

SEQ ID NO: 5775 - protein, 4 aa, synthetic construct
KSIY

SEQ ID NO: 5776 - protein, 4 aa, synthetic construct
KIIN

SEQ ID NO: 5777 - protein, 4 aa, synthetic construct
KAII

SEQ ID NO: 5778 - protein, 4 aa, synthetic construct
KAIS

SEQ ID NO: 5779 - protein, 4 aa, synthetic construct
KTVD

SEQ ID NO: 5780 - protein, 4 aa, synthetic construct
KTIE

SEQ ID NO: 5781 - protein, 4 aa, synthetic construct
KTIY

SEQ ID NO: 5782 - protein, 4 aa, synthetic construct
KNVV

SEQ ID NO: 5783 - protein, 4 aa, synthetic construct
KTDA

SEQ ID NO: 5784 - protein, 4 aa, synthetic construct
KTEM

SEQ ID NO: 5785 - protein, 4 aa, synthetic construct
KIVN

SEQ ID NO: 5786 - protein, 4 aa, synthetic construct
KIGN

SEQ ID NO: 5787 - protein, 4 aa, synthetic construct
KEVM

SEQ ID NO: 5788 - protein, 4 aa, synthetic construct
KYQV

SEQ ID NO: 5789 - protein, 4 aa, synthetic construct
KTVE

SEQ ID NO: 5790 - protein, 4 aa, synthetic construct
KAID

SEQ ID NO: 5791 - protein, 4 aa, synthetic construct
KTIM

SEQ ID NO: 5792 - protein, 4 aa, synthetic construct
KEVG

SEQ ID NO: 5793 - protein, 4 aa, synthetic construct
KSEM

SEQ ID NO: 5794 - protein, 4 aa, synthetic construct
KAQQ

SEQ ID NO: 5795 - protein, 4 aa, synthetic construct
KCGE

SEQ ID NO: 5796 - protein, 4 aa, synthetic construct
KASN

SEQ ID NO: 5797 - protein, 4 aa, synthetic construct
KTIG

SEQ ID NO: 5798 - protein, 4 aa, synthetic construct
KTDP

SEQ ID NO: 5799 - protein, 4 aa, synthetic construct
KELV

SEQ ID NO: 5800 - protein, 4 aa, synthetic construct
KELM

SEQ ID NO: 5801 - protein, 4 aa, synthetic construct
KNEI

SEQ ID NO: 5802 - protein, 4 aa, synthetic construct
KTPN

SEQ ID NO: 5803 - protein, 4 aa, synthetic construct
KITN

SEQ ID NO: 5804 - protein, 4 aa, synthetic construct
KTDI

SEQ ID NO: 5805 - protein, 4 aa, synthetic construct
KTDQ

SEQ ID NO: 5806 - protein, 4 aa, synthetic construct
KGIN

SEQ ID NO: 5807 - protein, 4 aa, synthetic construct
KSEI

SEQ ID NO: 5808 - protein, 4 aa, synthetic construct
KWSA

SEQ ID NO: 5809 - protein, 4 aa, synthetic construct
KELA

SEQ ID NO: 5810 - protein, 4 aa, synthetic construct
KQTQ

SEQ ID NO: 5811 - protein, 4 aa, synthetic construct
KGAD

SEQ ID NO: 5812 - protein, 4 aa, synthetic construct
KVGE

SEQ ID NO: 5813 - protein, 4 aa, synthetic construct
KANE

SEQ ID NO: 5814 - protein, 4 aa, synthetic construct
KTDT

SEQ ID NO: 5815 - protein, 4 aa, synthetic construct
KTCI

SEQ ID NO: 5816 - protein, 4 aa, synthetic construct
KELR

SEQ ID NO: 5817 - protein, 4 aa, synthetic construct
KCQI

SEQ ID NO: 5818 - protein, 4 aa, synthetic construct
KGVM

SEQ ID NO: 5819 - protein, 4 aa, synthetic construct
KACD

SEQ ID NO: 5820 - protein, 4 aa, synthetic construct
KNEL

SEQ ID NO: 5821 - protein, 4 aa, synthetic construct
KAAE

SEQ ID NO: 5822 - protein, 4 aa, synthetic construct
KGQN

SEQ ID NO: 5823 - protein, 4 aa, synthetic construct
KNEF

SEQ ID NO: 5824 - protein, 4 aa, synthetic construct
KTSI

SEQ ID NO: 5825 - protein, 4 aa, synthetic construct
KCDQ

SEQ ID NO: 5826 - protein, 4 aa, synthetic construct
KEIL

SEQ ID NO: 5827 - protein, 4 aa, synthetic construct
KTPD

SEQ ID NO: 5828 - protein, 18 aa, synthetic construct
KTINGHDSPHKSGQNQQT

SEQ ID NO: 5829 - protein, 4 aa, synthetic construct
SKAQ

SEQ ID NO: 5830 - protein, 4 aa, synthetic construct
SMYM

SEQ ID NO: 5831 - protein, 4 aa, synthetic construct
SKAF

SEQ ID NO: 5832 - protein, 4 aa, synthetic construct
SKLK

SEQ ID NO: 5833 - protein, 4 aa, synthetic construct
SKRH

SEQ ID NO: 5834 - protein, 4 aa, synthetic construct
SKWR

SEQ ID NO: 5835 - protein, 4 aa, synthetic construct
SRCR

SEQ ID NO: 5836 - protein, 4 aa, synthetic construct
SFTC

SEQ ID NO: 5837 - protein, 4 aa, synthetic construct
SKFF

SEQ ID NO: 5838 - protein, 4 aa, synthetic construct
IVWQ

SEQ ID NO: 5839 - protein, 4 aa, synthetic construct
SKYF

SEQ ID NO: 5840 - protein, 4 aa, synthetic construct
SKAR

SEQ ID NO: 5841 - protein, 4 aa, synthetic construct
SCHQ

SEQ ID NO: 5842 - protein, 4 aa, synthetic construct
FPWQ

SEQ ID NO: 5843 - protein, 4 aa, synthetic construct
SKIR

SEQ ID NO: 5844 - protein, 4 aa, synthetic construct
VYYQ

SEQ ID NO: 5845 - protein, 4 aa, synthetic construct
SLYW

SEQ ID NO: 5846 - protein, 4 aa, synthetic construct
SKPK

SEQ ID NO: 5847 - protein, 4 aa, synthetic construct
SRFW

SEQ ID NO: 5848 - protein, 4 aa, synthetic construct
SRMR

SEQ ID NO: 5849 - protein, 4 aa, synthetic construct
SVKK

SEQ ID NO: 5850 - protein, 4 aa, synthetic construct
SWAP

SEQ ID NO: 5851 - protein, 4 aa, synthetic construct
SLWK

SEQ ID NO: 5852 - protein, 4 aa, synthetic construct
SFRP

SEQ ID NO: 5853 - protein, 4 aa, synthetic construct
SKKV

SEQ ID NO: 5854 - protein, 4 aa, synthetic construct
SYAF

SEQ ID NO: 5855 - protein, 4 aa, synthetic construct
SKAC

SEQ ID NO: 5856 - protein, 4 aa, synthetic construct
SKRL

SEQ ID NO: 5857 - protein, 4 aa, synthetic construct
SCSR

SEQ ID NO: 5858 - protein, 4 aa, synthetic construct
SRCP

SEQ ID NO: 5859 - protein, 4 aa, synthetic construct
SGAC

SEQ ID NO: 5860 - protein, 4 aa, synthetic construct
SKFR

SEQ ID NO: 5861 - protein, 4 aa, synthetic construct
SFPF

SEQ ID NO: 5862 - protein, 4 aa, synthetic construct
SFFG

SEQ ID NO: 5863 - protein, 4 aa, synthetic construct
SMCQ

SEQ ID NO: 5864 - protein, 4 aa, synthetic construct
SKLF

SEQ ID NO: 5865 - protein, 4 aa, synthetic construct
SKTR

SEQ ID NO: 5866 - protein, 4 aa, synthetic construct
SGKR

SEQ ID NO: 5867 - protein, 4 aa, synthetic construct
FYRQ

SEQ ID NO: 5868 - protein, 4 aa, synthetic construct
CRVQ

SEQ ID NO: 5869 - protein, 4 aa, synthetic construct
YGIQ

SEQ ID NO: 5870 - protein, 4 aa, synthetic construct
VNCQ

SEQ ID NO: 5871 - protein, 4 aa, synthetic construct
SKPF

SEQ ID NO: 5872 - protein, 4 aa, synthetic construct
SLAW

SEQ ID NO: 5873 - protein, 4 aa, synthetic construct
SKRS

SEQ ID NO: 5874 - protein, 4 aa, synthetic construct
WSYQ

SEQ ID NO: 5875 - protein, 4 aa, synthetic construct
RWLQ

SEQ ID NO: 5876 - protein, 4 aa, synthetic construct
PSCQ

SEQ ID NO: 5877 - protein, 4 aa, synthetic construct
SSWL

SEQ ID NO: 5878 - protein, 4 aa, synthetic construct
SKRR

SEQ ID NO: 5879 - protein, 4 aa, synthetic construct
SKGC

SEQ ID NO: 5880 - protein, 4 aa, synthetic construct
VPWQ

SEQ ID NO: 5881 - protein, 4 aa, synthetic construct
SKRY

SEQ ID NO: 5882 - protein, 4 aa, synthetic construct
SGCQ

SEQ ID NO: 5883 - protein, 4 aa, synthetic construct
SFTP

SEQ ID NO: 5884 - protein, 4 aa, synthetic construct
STTC

SEQ ID NO: 5885 - protein, 4 aa, synthetic construct
PKRQ

SEQ ID NO: 5886 - protein, 4 aa, synthetic construct
SKCF

SEQ ID NO: 5887 - protein, 4 aa, synthetic construct
WVPQ

SEQ ID NO: 5888 - protein, 4 aa, synthetic construct
SFWS

SEQ ID NO: 5889 - protein, 4 aa, synthetic construct
SKFK

SEQ ID NO: 5890 - protein, 4 aa, synthetic construct
RIKQ

SEQ ID NO: 5891 - protein, 4 aa, synthetic construct
SKAP

SEQ ID NO: 5892 - protein, 4 aa, synthetic construct
SFRY

SEQ ID NO: 5893 - protein, 4 aa, synthetic construct
SKMI

SEQ ID NO: 5894 - protein, 4 aa, synthetic construct
LRWQ

SEQ ID NO: 5895 - protein, 4 aa, synthetic construct
LPTQ

SEQ ID NO: 5896 - protein, 4 aa, synthetic construct
SKWK

SEQ ID NO: 5897 - protein, 4 aa, synthetic construct
SYMR

SEQ ID NO: 5898 - protein, 4 aa, synthetic construct
SKAA

SEQ ID NO: 5899 - protein, 4 aa, synthetic construct
LLCQ

SEQ ID NO: 5900 - protein, 4 aa, synthetic construct
RCCQ

SEQ ID NO: 5901 - protein, 4 aa, synthetic construct
LCVQ

SEQ ID NO: 5902 - protein, 4 aa, synthetic construct
SKLT

SEQ ID NO: 5903 - protein, 4 aa, synthetic construct
SKLC

SEQ ID NO: 5904 - protein, 4 aa, synthetic construct
SYLV

SEQ ID NO: 5905 - protein, 4 aa, synthetic construct
QGCQ

SEQ ID NO: 5906 - protein, 4 aa, synthetic construct
MAFQ

SEQ ID NO: 5907 - protein, 4 aa, synthetic construct
SKWG

SEQ ID NO: 5908 - protein, 4 aa, synthetic construct
SKIL

SEQ ID NO: 5909 - protein, 4 aa, synthetic construct
SFQI

SEQ ID NO: 5910 - protein, 4 aa, synthetic construct
SKAL

SEQ ID NO: 5911 - protein, 4 aa, synthetic construct
SKAH

SEQ ID NO: 5912 - protein, 4 aa, synthetic construct
SLCL

SEQ ID NO: 5913 - protein, 4 aa, synthetic construct
RPWQ

SEQ ID NO: 5914 - protein, 4 aa, synthetic construct
RPRQ

SEQ ID NO: 5915 - protein, 4 aa, synthetic construct
SCPQ

SEQ ID NO: 5916 - protein, 4 aa, synthetic construct
SVRY

SEQ ID NO: 5917 - protein, 4 aa, synthetic construct
SVRC

SEQ ID NO: 5918 - protein, 4 aa, synthetic construct
SKMP

SEQ ID NO: 5919 - protein, 4 aa, synthetic construct
SKKT

SEQ ID NO: 5920 - protein, 4 aa, synthetic construct
SLPY

SEQ ID NO: 5921 - protein, 4 aa, synthetic construct
VYHQ

SEQ ID NO: 5922 - protein, 4 aa, synthetic construct
SYTR

SEQ ID NO: 5923 - protein, 4 aa, synthetic construct
LVYQ

SEQ ID NO: 5924 - protein, 4 aa, synthetic construct
YRYQ

SEQ ID NO: 5925 - protein, 4 aa, synthetic construct
SWLK

SEQ ID NO: 5926 - protein, 4 aa, synthetic construct
CPAQ

SEQ ID NO: 5927 - protein, 4 aa, synthetic construct
SMCT

SEQ ID NO: 5928 - protein, 4 aa, synthetic construct
SPPD

SEQ ID NO: 5929 - protein, 4 aa, synthetic construct
SKRN

SEQ ID NO: 5930 - protein, 4 aa, synthetic construct
RWTQ

SEQ ID NO: 5931 - protein, 4 aa, synthetic construct
PRKQ

SEQ ID NO: 5932 - protein, 4 aa, synthetic construct
SKCS

SEQ ID NO: 5933 - protein, 4 aa, synthetic construct
PFVQ

SEQ ID NO: 5934 - protein, 4 aa, synthetic construct
SKLP

SEQ ID NO: 5935 - protein, 4 aa, synthetic construct
SKSE

SEQ ID NO: 5936 - protein, 4 aa, synthetic construct
WVAQ

SEQ ID NO: 5937 - protein, 4 aa, synthetic construct
SLYQ

SEQ ID NO: 5938 - protein, 4 aa, synthetic construct
SKVR

SEQ ID NO: 5939 - protein, 4 aa, synthetic construct
CALQ

SEQ ID NO: 5940 - protein, 4 aa, synthetic construct
SSCT

SEQ ID NO: 5941 - protein, 4 aa, synthetic construct
SKNS

SEQ ID NO: 5942 - protein, 4 aa, synthetic construct
SKRK

SEQ ID NO: 5943 - protein, 4 aa, synthetic construct
LCTQ

SEQ ID NO: 5944 - protein, 4 aa, synthetic construct
STCL

SEQ ID NO: 5945 - protein, 4 aa, synthetic construct
SYAR

SEQ ID NO: 5946 - protein, 4 aa, synthetic construct
SKQR

SEQ ID NO: 5947 - protein, 4 aa, synthetic construct
SKRV

SEQ ID NO: 5948 - protein, 4 aa, synthetic construct
KSGQ

SEQ ID NO: 5949 - protein, 4 aa, synthetic construct
SYYS

SEQ ID NO: 5950 - protein, 4 aa, synthetic construct
SLTC

SEQ ID NO: 5951 - protein, 4 aa, synthetic construct
SCQS

SEQ ID NO: 5952 - protein, 4 aa, synthetic construct
SKAK

SEQ ID NO: 5953 - protein, 4 aa, synthetic construct
SKPQ

SEQ ID NO: 5954 - protein, 4 aa, synthetic construct
FPFQ

SEQ ID NO: 5955 - protein, 4 aa, synthetic construct
SKCT

SEQ ID NO: 5956 - protein, 4 aa, synthetic construct
SVFE

SEQ ID NO: 5957 - protein, 4 aa, synthetic construct
GRYQ

SEQ ID NO: 5958 - protein, 4 aa, synthetic construct
KAQA

SEQ ID NO: 5959 - protein, 4 aa, synthetic construct
KAQN

SEQ ID NO: 5960 - protein, 4 aa, synthetic construct
MYMN

SEQ ID NO: 5961 - protein, 4 aa, synthetic construct
KAFY

SEQ ID NO: 5962 - protein, 4 aa, synthetic construct
KLKR

SEQ ID NO: 5963 - protein, 4 aa, synthetic construct
KRHR

SEQ ID NO: 5964 - protein, 4 aa, synthetic construct
KAQK

SEQ ID NO: 5965 - protein, 4 aa, synthetic construct
KWRL

SEQ ID NO: 5966 - protein, 4 aa, synthetic construct
RCRN

SEQ ID NO: 5967 - protein, 4 aa, synthetic construct
FTCN

SEQ ID NO: 5968 - protein, 4 aa, synthetic construct
KFFI

SEQ ID NO: 5969 - protein, 4 aa, synthetic construct
KAQY

SEQ ID NO: 5970 - protein, 4 aa, synthetic construct
VWQN

SEQ ID NO: 5971 - protein, 4 aa, synthetic construct
KYFM

SEQ ID NO: 5972 - protein, 4 aa, synthetic construct
KARQ

SEQ ID NO: 5973 - protein, 4 aa, synthetic construct
CHQN

SEQ ID NO: 5974 - protein, 4 aa, synthetic construct
PWQN

SEQ ID NO: 5975 - protein, 4 aa, synthetic construct
KIRR

SEQ ID NO: 5976 - protein, 4 aa, synthetic construct
YYQN

SEQ ID NO: 5977 - protein, 4 aa, synthetic construct
LYWN

SEQ ID NO: 5978 - protein, 4 aa, synthetic construct
KPKR

SEQ ID NO: 5979 - protein, 4 aa, synthetic construct
KAFS

SEQ ID NO: 5980 - protein, 4 aa, synthetic construct
RFWN

SEQ ID NO: 5981 - protein, 4 aa, synthetic construct
KAQC

SEQ ID NO: 5982 - protein, 4 aa, synthetic construct
RMRN

SEQ ID NO: 5983 - protein, 4 aa, synthetic construct
VKKN

SEQ ID NO: 5984 - protein, 4 aa, synthetic construct
WAPN

SEQ ID NO: 5985 - protein, 4 aa, synthetic construct
LWKN

SEQ ID NO: 5986 - protein, 4 aa, synthetic construct
KARW

SEQ ID NO: 5987 - protein, 4 aa, synthetic construct
FRPN

SEQ ID NO: 5988 - protein, 4 aa, synthetic construct
KKVF

SEQ ID NO: 5989 - protein, 4 aa, synthetic construct
YAFN

SEQ ID NO: 5990 - protein, 4 aa, synthetic construct
KACS

SEQ ID NO: 5991 - protein, 4 aa, synthetic construct
KRLW

SEQ ID NO: 5992 - protein, 4 aa, synthetic construct
CSRN

SEQ ID NO: 5993 - protein, 4 aa, synthetic construct
RCPN

SEQ ID NO: 5994 - protein, 4 aa, synthetic construct
GACN

SEQ ID NO: 5995 - protein, 4 aa, synthetic construct
KFRQ

SEQ ID NO: 5996 - protein, 4 aa, synthetic construct
FPFN

SEQ ID NO: 5997 - protein, 4 aa, synthetic construct
FFGN

SEQ ID NO: 5998 - protein, 4 aa, synthetic construct
MCQN

SEQ ID NO: 5999 - protein, 4 aa, synthetic construct
KLFW

SEQ ID NO: 6000 - protein, 4 aa, synthetic construct
KTRK

SEQ ID NO: 6001 - protein, 4 aa, synthetic construct
GKRN

SEQ ID NO: 6002 - protein, 4 aa, synthetic construct
YRQN

SEQ ID NO: 6003 - protein, 4 aa, synthetic construct
RVQN

SEQ ID NO: 6004 - protein, 4 aa, synthetic construct
GIQN

SEQ ID NO: 6005 - protein, 4 aa, synthetic construct
KAQR

SEQ ID NO: 6006 - protein, 4 aa, synthetic construct
NCQN

SEQ ID NO: 6007 - protein, 4 aa, synthetic construct
KPFR

SEQ ID NO: 6008 - protein, 4 aa, synthetic construct
LAWN

SEQ ID NO: 6009 - protein, 4 aa, synthetic construct
KRSY

SEQ ID NO: 6010 - protein, 4 aa, synthetic construct
SYQN

SEQ ID NO: 6011 - protein, 4 aa, synthetic construct
WLQN

SEQ ID NO: 6012 - protein, 4 aa, synthetic construct
SCQN

SEQ ID NO: 6013 - protein, 4 aa, synthetic construct
SWLN

SEQ ID NO: 6014 - protein, 4 aa, synthetic construct
KRRA

SEQ ID NO: 6015 - protein, 4 aa, synthetic construct
KAQT

SEQ ID NO: 6016 - protein, 4 aa, synthetic construct
KGCT

SEQ ID NO: 6017 - protein, 4 aa, synthetic construct
KRYT

SEQ ID NO: 6018 - protein, 4 aa, synthetic construct
GCQN

SEQ ID NO: 6019 - protein, 4 aa, synthetic construct
FTPN

SEQ ID NO: 6020 - protein, 4 aa, synthetic construct
TTCN

SEQ ID NO: 6021 - protein, 4 aa, synthetic construct
KARM

SEQ ID NO: 6022 - protein, 4 aa, synthetic construct
KRQN

SEQ ID NO: 6023 - protein, 4 aa, synthetic construct
KCFL

SEQ ID NO: 6024 - protein, 4 aa, synthetic construct
VPQN

SEQ ID NO: 6025 - protein, 4 aa, synthetic construct
FWSN

SEQ ID NO: 6026 - protein, 4 aa, synthetic construct
KFKN

SEQ ID NO: 6027 - protein, 4 aa, synthetic construct
IKQN

SEQ ID NO: 6028 - protein, 4 aa, synthetic construct
KAPR

SEQ ID NO: 6029 - protein, 4 aa, synthetic construct
FRYN

SEQ ID NO: 6030 - protein, 4 aa, synthetic construct
KMIC

SEQ ID NO: 6031 - protein, 4 aa, synthetic construct
RWQN

SEQ ID NO: 6032 - protein, 4 aa, synthetic construct
PTQN

SEQ ID NO: 6033 - protein, 4 aa, synthetic construct
KWKS

SEQ ID NO: 6034 - protein, 4 aa, synthetic construct
YMRN

SEQ ID NO: 6035 - protein, 4 aa, synthetic construct
KAAR

SEQ ID NO: 6036 - protein, 4 aa, synthetic construct
LCQN

SEQ ID NO: 6037 - protein, 4 aa, synthetic construct
CCQN

SEQ ID NO: 6038 - protein, 4 aa, synthetic construct
CVQN

SEQ ID NO: 6039 - protein, 4 aa, synthetic construct
KLTR

SEQ ID NO: 6040 - protein, 4 aa, synthetic construct
KLCT

SEQ ID NO: 6041 - protein, 4 aa, synthetic construct
KIRG

SEQ ID NO: 6042 - protein, 4 aa, synthetic construct
YLVN

SEQ ID NO: 6043 - protein, 4 aa, synthetic construct
AFQN

SEQ ID NO: 6044 - protein, 4 aa, synthetic construct
KACQ

SEQ ID NO: 6045 - protein, 4 aa, synthetic construct
KWGL

SEQ ID NO: 6046 - protein, 4 aa, synthetic construct
KILR

SEQ ID NO: 6047 - protein, 4 aa, synthetic construct
FQIN

SEQ ID NO: 6048 - protein, 4 aa, synthetic construct
KACI

SEQ ID NO: 6049 - protein, 4 aa, synthetic construct
KALR

SEQ ID NO: 6050 - protein, 4 aa, synthetic construct
KAHA

SEQ ID NO: 6051 - protein, 4 aa, synthetic construct
LCLN

SEQ ID NO: 6052 - protein, 4 aa, synthetic construct
KAFV

SEQ ID NO: 6053 - protein, 4 aa, synthetic construct
PRQN

SEQ ID NO: 6054 - protein, 4 aa, synthetic construct
CPQN

SEQ ID NO: 6055 - protein, 4 aa, synthetic construct
KAQF

SEQ ID NO: 6056 - protein, 4 aa, synthetic construct
VRYN

SEQ ID NO: 6057 - protein, 4 aa, synthetic construct
VRCN

SEQ ID NO: 6058 - protein, 4 aa, synthetic construct
KMPC

SEQ ID NO: 6059 - protein, 4 aa, synthetic construct
KKTS

SEQ ID NO: 6060 - protein, 4 aa, synthetic construct
LPYN

SEQ ID NO: 6061 - protein, 4 aa, synthetic construct
YHQN

SEQ ID NO: 6062 - protein, 4 aa, synthetic construct
KAQS

SEQ ID NO: 6063 - protein, 4 aa, synthetic construct
YTRN

SEQ ID NO: 6064 - protein, 4 aa, synthetic construct
VYQN

SEQ ID NO: 6065 - protein, 4 aa, synthetic construct
RYQN

SEQ ID NO: 6066 - protein, 4 aa, synthetic construct
WLKN

SEQ ID NO: 6067 - protein, 4 aa, synthetic construct
KAQM

SEQ ID NO: 6068 - protein, 4 aa, synthetic construct
PAQN

SEQ ID NO: 6069 - protein, 4 aa, synthetic construct
MCTN

SEQ ID NO: 6070 - protein, 4 aa, synthetic construct
PPDN

SEQ ID NO: 6071 - protein, 4 aa, synthetic construct
KRNY

SEQ ID NO: 6072 - protein, 4 aa, synthetic construct
WTQN

SEQ ID NO: 6073 - protein, 4 aa, synthetic construct
KACR

SEQ ID NO: 6074 - protein, 4 aa, synthetic construct
RKQN

SEQ ID NO: 6075 - protein, 4 aa, synthetic construct
KCSV

SEQ ID NO: 6076 - protein, 4 aa, synthetic construct
KARI

SEQ ID NO: 6077 - protein, 4 aa, synthetic construct
FVQN

SEQ ID NO: 6078 - protein, 4 aa, synthetic construct
KLPK

SEQ ID NO: 6079 - protein, 4 aa, synthetic construct
KSEQ

SEQ ID NO: 6080 - protein, 4 aa, synthetic construct
VAQN

SEQ ID NO: 6081 - protein, 4 aa, synthetic construct
LYQN

SEQ ID NO: 6082 - protein, 4 aa, synthetic construct
KVRM

SEQ ID NO: 6083 - protein, 4 aa, synthetic construct
ALQN

SEQ ID NO: 6084 - protein, 4 aa, synthetic construct
SCTN

SEQ ID NO: 6085 - protein, 4 aa, synthetic construct
KNSR

SEQ ID NO: 6086 - protein, 4 aa, synthetic construct
KRKR

SEQ ID NO: 6087 - protein, 4 aa, synthetic construct
CTQN

SEQ ID NO: 6088 - protein, 4 aa, synthetic construct
TCLN

SEQ ID NO: 6089 - protein, 4 aa, synthetic construct
YARN

SEQ ID NO: 6090 - protein, 4 aa, synthetic construct
KQRP

SEQ ID NO: 6091 - protein, 4 aa, synthetic construct
KRVV

SEQ ID NO: 6092 - protein, 4 aa, synthetic construct
SGQN

SEQ ID NO: 6093 - protein, 4 aa, synthetic construct
YYSN

SEQ ID NO: 6094 - protein, 4 aa, synthetic construct
LTCN

SEQ ID NO: 6095 - protein, 4 aa, synthetic construct
CQSN

SEQ ID NO: 6096 - protein, 4 aa, synthetic construct
KAKG

SEQ ID NO: 6097 - protein, 4 aa, synthetic construct
KPQN

SEQ ID NO: 6098 - protein, 4 aa, synthetic construct
PFQN

SEQ ID NO: 6099 - protein, 4 aa, synthetic construct
KCTS

SEQ ID NO: 6100 - protein, 4 aa, synthetic construct
VFEN

SEQ ID NO: 6101 - protein, 4 aa, synthetic construct
KAKK

SEQ ID NO: 6102 - protein, 5 aa, synthetic construct
SKAQA

SEQ ID NO: 6103 - protein, 5 aa, synthetic construct
SKAQN

SEQ ID NO: 6104 - protein, 5 aa, synthetic construct
SMYMN

SEQ ID NO: 6105 - protein, 5 aa, synthetic construct
SKAFY

SEQ ID NO: 6106 - protein, 5 aa, synthetic construct
SKLKR

SEQ ID NO: 6107 - protein, 5 aa, synthetic construct
SKRHR

SEQ ID NO: 6108 - protein, 5 aa, synthetic construct
SKAQK

SEQ ID NO: 6109 - protein, 5 aa, synthetic construct
SKWRL

SEQ ID NO: 6110 - protein, 5 aa, synthetic construct
SRCRN

SEQ ID NO: 6111 - protein, 5 aa, synthetic construct
SFTCN

SEQ ID NO: 6112 - protein, 5 aa, synthetic construct
SKFFI

SEQ ID NO: 6113 - protein, 5 aa, synthetic construct
SKAQY

SEQ ID NO: 6114 - protein, 5 aa, synthetic construct
IVWQN

SEQ ID NO: 6115 - protein, 5 aa, synthetic construct
SKYFM

SEQ ID NO: 6116 - protein, 5 aa, synthetic construct
SKARQ

SEQ ID NO: 6117 - protein, 5 aa, synthetic construct
SCHQN

SEQ ID NO: 6118 - protein, 5 aa, synthetic construct
FPWQN

SEQ ID NO: 6119 - protein, 5 aa, synthetic construct
SKIRR

SEQ ID NO: 6120 - protein, 5 aa, synthetic construct
VYYQN

SEQ ID NO: 6121 - protein, 5 aa, synthetic construct
SLYWN

SEQ ID NO: 6122 - protein, 5 aa, synthetic construct
SKPKR

SEQ ID NO: 6123 - protein, 5 aa, synthetic construct
SKAFS

SEQ ID NO: 6124 - protein, 5 aa, synthetic construct
SRFWN

SEQ ID NO: 6125 - protein, 5 aa, synthetic construct
SKAQC

SEQ ID NO: 6126 - protein, 5 aa, synthetic construct
SRMRN

SEQ ID NO: 6127 - protein, 5 aa, synthetic construct
SVKKN

SEQ ID NO: 6128 - protein, 5 aa, synthetic construct
SWAPN

SEQ ID NO: 6129 - protein, 5 aa, synthetic construct
SLWKN

SEQ ID NO: 6130 - protein, 5 aa, synthetic construct
SKARW

SEQ ID NO: 6131 - protein, 5 aa, synthetic construct
SFRPN

SEQ ID NO: 6132 - protein, 5 aa, synthetic construct
SKKVF

SEQ ID NO: 6133 - protein, 5 aa, synthetic construct
SYAFN

SEQ ID NO: 6134 - protein, 5 aa, synthetic construct
SKACS

SEQ ID NO: 6135 - protein, 5 aa, synthetic construct
SKRLW

SEQ ID NO: 6136 - protein, 5 aa, synthetic construct
SCSRN

SEQ ID NO: 6137 - protein, 5 aa, synthetic construct
SRCPN

SEQ ID NO: 6138 - protein, 5 aa, synthetic construct
SGACN

SEQ ID NO: 6139 - protein, 5 aa, synthetic construct
SKFRQ

SEQ ID NO: 6140 - protein, 5 aa, synthetic construct
SFPFN

SEQ ID NO: 6141 - protein, 5 aa, synthetic construct
SFFGN

SEQ ID NO: 6142 - protein, 5 aa, synthetic construct
SMCQN

SEQ ID NO: 6143 - protein, 5 aa, synthetic construct
SKLFW

SEQ ID NO: 6144 - protein, 5 aa, synthetic construct
SKTRK

SEQ ID NO: 6145 - protein, 5 aa, synthetic construct
SGKRN

SEQ ID NO: 6146 - protein, 5 aa, synthetic construct
FYRQN

SEQ ID NO: 6147 - protein, 5 aa, synthetic construct
CRVQN

SEQ ID NO: 6148 - protein, 5 aa, synthetic construct
YGIQN

SEQ ID NO: 6149 - protein, 5 aa, synthetic construct
SKAQR

SEQ ID NO: 6150 - protein, 5 aa, synthetic construct
VNCQN

SEQ ID NO: 6151 - protein, 5 aa, synthetic construct
SKPFR

SEQ ID NO: 6152 - protein, 5 aa, synthetic construct
SLAWN

SEQ ID NO: 6153 - protein, 5 aa, synthetic construct
SKRSY

SEQ ID NO: 6154 - protein, 5 aa, synthetic construct
WSYQN

SEQ ID NO: 6155 - protein, 5 aa, synthetic construct
RWLQN

SEQ ID NO: 6156 - protein, 5 aa, synthetic construct
PSCQN

SEQ ID NO: 6157 - protein, 5 aa, synthetic construct
SSWLN

SEQ ID NO: 6158 - protein, 5 aa, synthetic construct
SKRRA

SEQ ID NO: 6159 - protein, 5 aa, synthetic construct
SKAQT

SEQ ID NO: 6160 - protein, 5 aa, synthetic construct
SKGCT

SEQ ID NO: 6161 - protein, 5 aa, synthetic construct
VPWQN

SEQ ID NO: 6162 - protein, 5 aa, synthetic construct
SKRYT

SEQ ID NO: 6163 - protein, 5 aa, synthetic construct
SGCQN

SEQ ID NO: 6164 - protein, 5 aa, synthetic construct
SFTPN

SEQ ID NO: 6165 - protein, 5 aa, synthetic construct
STTCN

SEQ ID NO: 6166 - protein, 5 aa, synthetic construct
SKARM

SEQ ID NO: 6167 - protein, 5 aa, synthetic construct
PKRQN

SEQ ID NO: 6168 - protein, 5 aa, synthetic construct
SKCFL

SEQ ID NO: 6169 - protein, 5 aa, synthetic construct
WVPQN

SEQ ID NO: 6170 - protein, 5 aa, synthetic construct
SFWSN

SEQ ID NO: 6171 - protein, 5 aa, synthetic construct
SKFKN

SEQ ID NO: 6172 - protein, 5 aa, synthetic construct
RIKQN

SEQ ID NO: 6173 - protein, 5 aa, synthetic construct
SKAPR

SEQ ID NO: 6174 - protein, 5 aa, synthetic construct
SFRYN

SEQ ID NO: 6175 - protein, 5 aa, synthetic construct
SKMIC

SEQ ID NO: 6176 - protein, 5 aa, synthetic construct
LRWQN

SEQ ID NO: 6177 - protein, 5 aa, synthetic construct
LPTQN

SEQ ID NO: 6178 - protein, 5 aa, synthetic construct
SKWKS

SEQ ID NO: 6179 - protein, 5 aa, synthetic construct
SYMRN

SEQ ID NO: 6180 - protein, 5 aa, synthetic construct
SKAAR

SEQ ID NO: 6181 - protein, 5 aa, synthetic construct
LLCQN

SEQ ID NO: 6182 - protein, 5 aa, synthetic construct
RCCQN

SEQ ID NO: 6183 - protein, 5 aa, synthetic construct
LCVQN

SEQ ID NO: 6184 - protein, 5 aa, synthetic construct
SKLTR

SEQ ID NO: 6185 - protein, 5 aa, synthetic construct
SKLCT

SEQ ID NO: 6186 - protein, 5 aa, synthetic construct
SKIRG

SEQ ID NO: 6187 - protein, 5 aa, synthetic construct
SYLVN

SEQ ID NO: 6188 - protein, 5 aa, synthetic construct
QGCQN

SEQ ID NO: 6189 - protein, 5 aa, synthetic construct
MAFQN

SEQ ID NO: 6190 - protein, 5 aa, synthetic construct
SKACQ

SEQ ID NO: 6191 - protein, 5 aa, synthetic construct
SKWGL

SEQ ID NO: 6192 - protein, 5 aa, synthetic construct
SKILR

SEQ ID NO: 6193 - protein, 5 aa, synthetic construct
SFQIN

SEQ ID NO: 6194 - protein, 5 aa, synthetic construct
SKACI

SEQ ID NO: 6195 - protein, 5 aa, synthetic construct
SKALR

SEQ ID NO: 6196 - protein, 5 aa, synthetic construct
SKAHA

SEQ ID NO: 6197 - protein, 5 aa, synthetic construct
SLCLN

SEQ ID NO: 6198 - protein, 5 aa, synthetic construct
SKAFV

SEQ ID NO: 6199 - protein, 5 aa, synthetic construct
RPWQN

SEQ ID NO: 6200 - protein, 5 aa, synthetic construct
RPRQN

SEQ ID NO: 6201 - protein, 5 aa, synthetic construct
SCPQN

SEQ ID NO: 6202 - protein, 5 aa, synthetic construct
SKAQF

SEQ ID NO: 6203 - protein, 5 aa, synthetic construct
SVRYN

SEQ ID NO: 6204 - protein, 5 aa, synthetic construct
SVRCN

SEQ ID NO: 6205 - protein, 5 aa, synthetic construct
SKMPC

SEQ ID NO: 6206 - protein, 5 aa, synthetic construct
SKKTS

SEQ ID NO: 6207 - protein, 5 aa, synthetic construct
SLPYN

SEQ ID NO: 6208 - protein, 5 aa, synthetic construct
VYHQN

SEQ ID NO: 6209 - protein, 5 aa, synthetic construct
SKAQS

SEQ ID NO: 6210 - protein, 5 aa, synthetic construct
SYTRN

SEQ ID NO: 6211 - protein, 5 aa, synthetic construct
LVYQN

SEQ ID NO: 6212 - protein, 5 aa, synthetic construct
YRYQN

SEQ ID NO: 6213 - protein, 5 aa, synthetic construct
SWLKN

SEQ ID NO: 6214 - protein, 5 aa, synthetic construct
SKAQM

SEQ ID NO: 6215 - protein, 5 aa, synthetic construct
CPAQN

SEQ ID NO: 6216 - protein, 5 aa, synthetic construct
SMCTN

SEQ ID NO: 6217 - protein, 5 aa, synthetic construct
SPPDN

SEQ ID NO: 6218 - protein, 5 aa, synthetic construct
SKRNY

SEQ ID NO: 6219 - protein, 5 aa, synthetic construct
RWTQN

SEQ ID NO: 6220 - protein, 5 aa, synthetic construct
SKACR

SEQ ID NO: 6221 - protein, 5 aa, synthetic construct
PRKQN

SEQ ID NO: 6222 - protein, 5 aa, synthetic construct
SKCSV

SEQ ID NO: 6223 - protein, 5 aa, synthetic construct
SKARI

SEQ ID NO: 6224 - protein, 5 aa, synthetic construct
PFVQN

SEQ ID NO: 6225 - protein, 5 aa, synthetic construct
SKLPK

SEQ ID NO: 6226 - protein, 5 aa, synthetic construct
SKSEQ

SEQ ID NO: 6227 - protein, 5 aa, synthetic construct
WVAQN

SEQ ID NO: 6228 - protein, 5 aa, synthetic construct
SLYQN

SEQ ID NO: 6229 - protein, 5 aa, synthetic construct
SKVRM

SEQ ID NO: 6230 - protein, 5 aa, synthetic construct
CALQN

SEQ ID NO: 6231 - protein, 5 aa, synthetic construct
SSCTN

SEQ ID NO: 6232 - protein, 5 aa, synthetic construct
SKNSR

SEQ ID NO: 6233 - protein, 5 aa, synthetic construct
SKRKR

SEQ ID NO: 6234 - protein, 5 aa, synthetic construct
LCTQN

SEQ ID NO: 6235 - protein, 5 aa, synthetic construct
STCLN

SEQ ID NO: 6236 - protein, 5 aa, synthetic construct
SYARN

SEQ ID NO: 6237 - protein, 5 aa, synthetic construct
SKQRP

SEQ ID NO: 6238 - protein, 5 aa, synthetic construct
SKRVV

SEQ ID NO: 6239 - protein, 5 aa, synthetic construct
KSGQN

SEQ ID NO: 6240 - protein, 5 aa, synthetic construct
SYYSN

SEQ ID NO: 6241 - protein, 5 aa, synthetic construct
SLTCN

SEQ ID NO: 6242 - protein, 5 aa, synthetic construct
SCQSN

SEQ ID NO: 6243 - protein, 5 aa, synthetic construct
SKAKG

SEQ ID NO: 6244 - protein, 5 aa, synthetic construct
SKPQN

SEQ ID NO: 6245 - protein, 5 aa, synthetic construct
FPFQN

SEQ ID NO: 6246 - protein, 5 aa, synthetic construct
SKCTS

SEQ ID NO: 6247 - protein, 5 aa, synthetic construct
SVFEN

SEQ ID NO: 6248 - protein, 5 aa, synthetic construct
SKAKK

SEQ ID NO: 6249 - protein, 5 aa, synthetic construct
GRYQN

SEQ ID NO: 6250 - protein, 11 aa, synthetic construct
GSGSPHSKAQA

SEQ ID NO: 6251 - protein, 11 aa, synthetic construct
GSGSPHSKAQN

SEQ ID NO: 6252 - protein, 11 aa, synthetic construct
GSGSPHSMYMN

SEQ ID NO: 6253 - protein, 11 aa, synthetic construct
GSGSPHSKAFY

SEQ ID NO: 6254 - protein, 11 aa, synthetic construct
GSGSPHSKLKR

SEQ ID NO: 6255 - protein, 11 aa, synthetic construct
GSGSPHSKRHR

SEQ ID NO: 6256 - protein, 11 aa, synthetic construct
GSGSPHSKAQK

SEQ ID NO: 6257 - protein, 11 aa, synthetic construct
GSGSPHSKWRL

SEQ ID NO: 6258 - protein, 11 aa, synthetic construct
GSGSPHSRCRN

SEQ ID NO: 6259 - protein, 11 aa, synthetic construct
GSGSPHSFTCN

SEQ ID NO: 6260 - protein, 11 aa, synthetic construct
GSGSPHSKFFI

SEQ ID NO: 6261 - protein, 11 aa, synthetic construct
GSGSPHSKAQY

SEQ ID NO: 6262 - protein, 11 aa, synthetic construct
GSGSPHIVWQN

SEQ ID NO: 6263 - protein, 11 aa, synthetic construct
GSGSPHSKYFM

SEQ ID NO: 6264 - protein, 11 aa, synthetic construct
GSGSPHSKARQ

SEQ ID NO: 6265 - protein, 11 aa, synthetic construct
GSGSPHSCHQN

SEQ ID NO: 6266 - protein, 11 aa, synthetic construct
GSGSPHFPWQN

SEQ ID NO: 6267 - protein, 11 aa, synthetic construct
GSGSPHSKIRR

SEQ ID NO: 6268 - protein, 11 aa, synthetic construct
GSGSPHVYYQN

SEQ ID NO: 6269 - protein, 11 aa, synthetic construct
GSGSPHSLYWN

SEQ ID NO: 6270 - protein, 11 aa, synthetic construct
GSGSPHSKPKR

SEQ ID NO: 6271 - protein, 11 aa, synthetic construct
GSGSPHSKAFS

SEQ ID NO: 6272 - protein, 11 aa, synthetic construct
GSGSPHSRFWN

SEQ ID NO: 6273 - protein, 11 aa, synthetic construct
GSGSPHSKAQC

SEQ ID NO: 6274 - protein, 11 aa, synthetic construct
GSGSPHSRMRN

SEQ ID NO: 6275 - protein, 11 aa, synthetic construct
GSGSPHSVKKN

SEQ ID NO: 6276 - protein, 11 aa, synthetic construct
GSGSPHSWAPN

SEQ ID NO: 6277 - protein, 11 aa, synthetic construct
GSGSPHSLWKN

SEQ ID NO: 6278 - protein, 11 aa, synthetic construct
GSGSPHSKARW

SEQ ID NO: 6279 - protein, 11 aa, synthetic construct
GSGSPHSFRPN

SEQ ID NO: 6280 - protein, 11 aa, synthetic construct
GSGSPHSKKVF

SEQ ID NO: 6281 - protein, 11 aa, synthetic construct
GSGSPHSYAFN

SEQ ID NO: 6282 - protein, 11 aa, synthetic construct
GSGSPHSKACS

SEQ ID NO: 6283 - protein, 11 aa, synthetic construct
GSGSPHSKRLW

SEQ ID NO: 6284 - protein, 11 aa, synthetic construct
GSGSPHSCSRN

SEQ ID NO: 6285 - protein, 11 aa, synthetic construct
GSGSPHSRCPN

SEQ ID NO: 6286 - protein, 11 aa, synthetic construct
GSGSPHSGACN

SEQ ID NO: 6287 - protein, 11 aa, synthetic construct
GSGSPHSKFRQ

SEQ ID NO: 6288 - protein, 11 aa, synthetic construct
GSGSPHSFPFN

SEQ ID NO: 6289 - protein, 11 aa, synthetic construct
GSGSPHSFFGN

SEQ ID NO: 6290 - protein, 11 aa, synthetic construct
GSGSPHSMCQN

SEQ ID NO: 6291 - protein, 11 aa, synthetic construct
GSGSPHSKLFW

SEQ ID NO: 6292 - protein, 11 aa, synthetic construct
GSGSPHSKTRK

SEQ ID NO: 6293 - protein, 11 aa, synthetic construct
GSGSPHSGKRN

SEQ ID NO: 6294 - protein, 11 aa, synthetic construct
GSGSPHFYRQN

SEQ ID NO: 6295 - protein, 11 aa, synthetic construct
GSGSPHCRVQN

SEQ ID NO: 6296 - protein, 11 aa, synthetic construct
GSGSPHYGIQN

SEQ ID NO: 6297 - protein, 11 aa, synthetic construct
GSGSPHSKAQR

SEQ ID NO: 6298 - protein, 11 aa, synthetic construct
GSGSPHVNCQN

SEQ ID NO: 6299 - protein, 11 aa, synthetic construct
GSGSPHSKPFR

SEQ ID NO: 6300 - protein, 11 aa, synthetic construct
GSGSPHSLAWN

SEQ ID NO: 6301 - protein, 11 aa, synthetic construct
GSGSPHSKRSY

SEQ ID NO: 6302 - protein, 11 aa, synthetic construct
GSGSPHWSYQN

SEQ ID NO: 6303 - protein, 11 aa, synthetic construct
GSGSPHRWLQN

SEQ ID NO: 6304 - protein, 11 aa, synthetic construct
GSGSPHPSCQN

SEQ ID NO: 6305 - protein, 11 aa, synthetic construct
GSGSPHSSWLN

SEQ ID NO: 6306 - protein, 11 aa, synthetic construct
GSGSPHSKRRA

SEQ ID NO: 6307 - protein, 11 aa, synthetic construct
GSGSPHSKAQT

SEQ ID NO: 6308 - protein, 11 aa, synthetic construct
GSGSPHSKGCT

SEQ ID NO: 6309 - protein, 11 aa, synthetic construct
GSGSPHVPWQN

SEQ ID NO: 6310 - protein, 11 aa, synthetic construct
GSGSPHSKRYT

SEQ ID NO: 6311 - protein, 11 aa, synthetic construct
GSGSPHSGCQN

SEQ ID NO: 6312 - protein, 11 aa, synthetic construct
GSGSPHSFTPN

SEQ ID NO: 6313 - protein, 11 aa, synthetic construct
GSGSPHSTTCN

SEQ ID NO: 6314 - protein, 11 aa, synthetic construct
GSGSPHSKARM

SEQ ID NO: 6315 - protein, 11 aa, synthetic construct
GSGSPHPKRQN

SEQ ID NO: 6316 - protein, 11 aa, synthetic construct
GSGSPHSKCFL

SEQ ID NO: 6317 - protein, 11 aa, synthetic construct
GSGSPHWVPQN

SEQ ID NO: 6318 - protein, 11 aa, synthetic construct
GSGSPHSFWSN

SEQ ID NO: 6319 - protein, 11 aa, synthetic construct
GSGSPHSKFKN

SEQ ID NO: 6320 - protein, 11 aa, synthetic construct
GSGSPHRIKQN

SEQ ID NO: 6321 - protein, 11 aa, synthetic construct
GSGSPHSKAPR

SEQ ID NO: 6322 - protein, 11 aa, synthetic construct
GSGSPHSFRYN

SEQ ID NO: 6323 - protein, 11 aa, synthetic construct
GSGSPHSKMIC

SEQ ID NO: 6324 - protein, 11 aa, synthetic construct
GSGSPHLRWQN

SEQ ID NO: 6325 - protein, 11 aa, synthetic construct
GSGSPHLPTQN

SEQ ID NO: 6326 - protein, 11 aa, synthetic construct
GSGSPHSKWKS

SEQ ID NO: 6327 - protein, 11 aa, synthetic construct
GSGSPHSYMRN

SEQ ID NO: 6328 - protein, 11 aa, synthetic construct
GSGSPHSKAAR

SEQ ID NO: 6329 - protein, 11 aa, synthetic construct
GSGSPHLLCQN

SEQ ID NO: 6330 - protein, 11 aa, synthetic construct
GSGSPHRCCQN

SEQ ID NO: 6331 - protein, 11 aa, synthetic construct
GSGSPHLCVQN

SEQ ID NO: 6332 - protein, 11 aa, synthetic construct
GSGSPHSKLTR

SEQ ID NO: 6333 - protein, 11 aa, synthetic construct
GSGSPHSKLCT

SEQ ID NO: 6334 - protein, 11 aa, synthetic construct
GSGSPHSKIRG

SEQ ID NO: 6335 - protein, 11 aa, synthetic construct
GSGSPHSYLVN

SEQ ID NO: 6336 - protein, 11 aa, synthetic construct
GSGSPHQGCQN

SEQ ID NO: 6337 - protein, 11 aa, synthetic construct
GSGSPHMAFQN

SEQ ID NO: 6338 - protein, 11 aa, synthetic construct
GSGSPHSKACQ

SEQ ID NO: 6339 - protein, 11 aa, synthetic construct
GSGSPHSKWGL

SEQ ID NO: 6340 - protein, 11 aa, synthetic construct
GSGSPHSKILR

SEQ ID NO: 6341 - protein, 11 aa, synthetic construct
GSGSPHSFQIN

SEQ ID NO: 6342 - protein, 11 aa, synthetic construct
GSGSPHSKACI

SEQ ID NO: 6343 - protein, 11 aa, synthetic construct
GSGSPHSKALR

SEQ ID NO: 6344 - protein, 11 aa, synthetic construct
GSGSPHSKAHA

SEQ ID NO: 6345 - protein, 11 aa, synthetic construct
GSGSPHSLCLN

SEQ ID NO: 6346 - protein, 11 aa, synthetic construct
GSGSPHSKAFV

SEQ ID NO: 6347 - protein, 11 aa, synthetic construct
GSGSPHRPWQN

SEQ ID NO: 6348 - protein, 11 aa, synthetic construct
GSGSPHRPRQN

SEQ ID NO: 6349 - protein, 11 aa, synthetic construct
GSGSPHSCPQN

SEQ ID NO: 6350 - protein, 11 aa, synthetic construct
GSGSPHSKAQF

SEQ ID NO: 6351 - protein, 11 aa, synthetic construct
GSGSPHSVRYN

SEQ ID NO: 6352 - protein, 11 aa, synthetic construct
GSGSPHSVRCN

SEQ ID NO: 6353 - protein, 11 aa, synthetic construct
GSGSPHSKMPC

SEQ ID NO: 6354 - protein, 11 aa, synthetic construct
GSGSPHSKKTS

SEQ ID NO: 6355 - protein, 11 aa, synthetic construct
GSGSPHSLPYN

SEQ ID NO: 6356 - protein, 11 aa, synthetic construct
GSGSPHVYHQN

SEQ ID NO: 6357 - protein, 11 aa, synthetic construct
GSGSPHSKAQS

SEQ ID NO: 6358 - protein, 11 aa, synthetic construct
GSGSPHSYTRN

SEQ ID NO: 6359 - protein, 11 aa, synthetic construct
GSGSPHLVYQN

SEQ ID NO: 6360 - protein, 11 aa, synthetic construct
GSGSPHYRYQN

SEQ ID NO: 6361 - protein, 11 aa, synthetic construct
GSGSPHSWLKN

SEQ ID NO: 6362 - protein, 11 aa, synthetic construct
GSGSPHSKAQM

SEQ ID NO: 6363 - protein, 11 aa, synthetic construct
GSGSPHCPAQN

SEQ ID NO: 6364 - protein, 11 aa, synthetic construct
GSGSPHSMCTN

SEQ ID NO: 6365 - protein, 11 aa, synthetic construct
GSGSPHSPPDN

SEQ ID NO: 6366 - protein, 11 aa, synthetic construct
GSGSPHSKRNY

SEQ ID NO: 6367 - protein, 11 aa, synthetic construct
GSGSPHRWTQN

SEQ ID NO: 6368 - protein, 11 aa, synthetic construct
GSGSPHSKACR

SEQ ID NO: 6369 - protein, 11 aa, synthetic construct
GSGSPHPRKQN

SEQ ID NO: 6370 - protein, 11 aa, synthetic construct
GSGSPHSKCSV

SEQ ID NO: 6371 - protein, 11 aa, synthetic construct
GSGSPHSKARI

SEQ ID NO: 6372 - protein, 11 aa, synthetic construct
GSGSPHPFVQN

SEQ ID NO: 6373 - protein, 11 aa, synthetic construct
GSGSPHSKLPK

SEQ ID NO: 6374 - protein, 11 aa, synthetic construct
GSGSPHSKSEQ

SEQ ID NO: 6375 - protein, 11 aa, synthetic construct
GSGSPHWVAQN

SEQ ID NO: 6376 - protein, 11 aa, synthetic construct
GSGSPHSLYQN

SEQ ID NO: 6377 - protein, 11 aa, synthetic construct
GSGSPHSKVRM

SEQ ID NO: 6378 - protein, 11 aa, synthetic construct
GSGSPHCALQN

SEQ ID NO: 6379 - protein, 11 aa, synthetic construct
GSGSPHSSCTN

SEQ ID NO: 6380 - protein, 11 aa, synthetic construct
GSGSPHSKNSR

SEQ ID NO: 6381 - protein, 11 aa, synthetic construct
GSGSPHSKRKR

SEQ ID NO: 6382 - protein, 11 aa, synthetic construct
GSGSPHLCTQN

SEQ ID NO: 6383 - protein, 11 aa, synthetic construct
GSGSPHSTCLN

SEQ ID NO: 6384 - protein, 11 aa, synthetic construct
GSGSPHSYARN

SEQ ID NO: 6385 - protein, 11 aa, synthetic construct
GSGSPHSKQRP

SEQ ID NO: 6386 - protein, 11 aa, synthetic construct
GSGSPHSKRVV

SEQ ID NO: 6387 - protein, 11 aa, synthetic construct
GSGSPHKSGQN

SEQ ID NO: 6388 - protein, 11 aa, synthetic construct
GSGSPHSYYSN

SEQ ID NO: 6389 - protein, 11 aa, synthetic construct
GSGSPHSLTCN

SEQ ID NO: 6390 - protein, 11 aa, synthetic construct
GSGSPHSCQSN

SEQ ID NO: 6391 - protein, 11 aa, synthetic construct
GSGSPHSKAKG

SEQ ID NO: 6392 - protein, 11 aa, synthetic construct
GSGSPHSKPQN

SEQ ID NO: 6393 - protein, 11 aa, synthetic construct
GSGSPHFPFQN

SEQ ID NO: 6394 - protein, 11 aa, synthetic construct
GSGSPHSKCTS

SEQ ID NO: 6395 - protein, 11 aa, synthetic construct
GSGSPHSVFEN

SEQ ID NO: 6396 - protein, 11 aa, synthetic construct
GSGSPHSKAKK

SEQ ID NO: 6397 - protein, 11 aa, synthetic construct
GSGSPHGRYQN

SEQ ID NO: 6398 - protein, 4 aa, synthetic construct
SPHK

SEQ ID NO: 6399 - protein, 11 aa, synthetic construct
ERVSGSPHSKA

SEQ ID NO: 6400 - protein, 12 aa, synthetic construct
AEIGHDSPHKSG

SEQ ID NO: 6401 - protein, 11 aa, synthetic construct
EKMSGSPHSKA

SEQ ID NO: 6402 - protein, 11 aa, synthetic construct
HDSPHSKAQNL

SEQ ID NO: 6403 - protein, 11 aa, synthetic construct
VNGHDSPHSKA

SEQ ID NO: 6404 - protein, 27 aa, synthetic construct
KTINGSGQNQQTLKFSVAGPSNMAVQG

SEQ ID NO: 6405 - protein, 12 aa, synthetic construct
KTINGSGQNQQT

SEQ ID NO: 6406 - protein, 8 aa, synthetic construct
GSGQNQQT

SEQ ID NO: 6407 - protein, 9 aa, synthetic construct
  VARIANT 1: note = Any amino acid
  VARIANT 7: note = Any amino acid
  VARIANT 9: note = Any amino acid
XSGSPHXKX

SEQ ID NO: 6408 - protein, 9 aa, synthetic construct
  VARIANT 1: note = Any amino acid
  VARIANT 2: note = A, C, D, E, F, G, H, I, K, L, M, N, P, Q, R, T, V, W or Y
  VARIANT 3: note = A, C, D, E, F, H, I, K, L, M, N, P, Q, R, S, T, V, W or Y
  VARIANT 8: note = Any amino acid
  VARIANT 9: note = Any amino acid
XXXSPHKXX

We claim:

1. An adeno-associated virus (AAV) capsid variant comprising an amino acid sequence at least 95% identical to amino acids 203-742 of SEQ ID NO: 982, wherein the amino acid sequence comprises HDSPHK (SEQ ID NO: 2) in variable region IV (VR-IV).

2. The AAV capsid variant of claim 1, wherein the amino acid sequence of HDSPHK (SEQ ID NO: 2) is present immediately subsequent to amino acid 453, numbered according to SEQ ID NO: 982.

3. The AAV capsid variant of claim 1, which comprises an amino acid sequence at least 98% identical to amino acids 203-742 of SEQ ID NO: 982.

4. The AAV capsid variant of claim 1, which comprises an amino acid sequence at least 95% identical to amino acids 138-742 of SEQ ID NO: 982.

5. The AAV capsid variant of claim 1, which comprises an amino acid sequence at least 95% or at least 98% identical to amino acids 138-742 of SEQ ID NO: 982.

6. The AAV capsid variant of claim 1, which comprises the amino acid sequence of amino acids 138-742 of SEQ ID NO: 982.

7. The AAV capsid variant of claim 1, which comprises an amino acid sequence at least 95% identical to the amino acid sequence of SEQ ID NO: 982.

8. The AAV capsid variant of claim 1, which comprises an amino acid sequence at least 98% identical to the amino acid sequence of SEQ ID NO: 982.

9. The AAV capsid variant of claim 1, which comprises the amino acid sequence of amino acids 203-742 of SEQ ID NO: 982.

10. An AAV particle comprising the AAV capsid variant of claim 9.

11. A pharmaceutical composition comprising an AAV particle comprising the AAV capsid variant of claim 9, and a pharmaceutically acceptable excipient.

12. A cell comprising the AAV capsid variant of claim 1.

13. The cell of claim 12, which is:
(i) a mammalian cell or an insect cell;
(ii) a cell of a brain region or a spinal cord region; or
(iii) a neuron or an astrocyte.

14. A pharmaceutical composition comprising an AAV particle comprising the AAV capsid variant of claim 1, and a pharmaceutically acceptable excipient.

15. A method of making an AAV particle, comprising:
(i) providing a host cell comprising a viral genome and a polynucleotide encoding the AAV capsid variant of claim 1; and
(ii) incubating the host cell under conditions suitable to enclose the viral genome in the AAV capsid variant; thereby making the AAV particle.

16. A method of delivering a payload to a cell or tissue, comprising administering an effective amount of an AAV particle comprising the AAV capsid variant of claim 1, thereby delivering the payload to the cell or tissue.

17. The method of claim 16, wherein the cell or tissue is present in a subject and the AAV particle is administered intravenously, via intra-cisterna magna injection (ICM), intracerebrally, intrathecally, intracerebroventricularly, via intraparenchymal administration, or intramuscularly to the subject.

18. The method of claim 16, wherein:
(i) the cell is a neuron, a motor neuron, an astrocyte, a glial cell, or an oligodendrocyte; or
(ii) the tissue is a brain tissue or a spinal cord tissue, wherein the brain tissue or the spinal cord tissue is a putamen, substantia *nigra*, frontal cortex, motor cortex, temporal cortex, caudate, dentate nucleus, brain stem, cerebral cortex, brain stem, hippocampus, thalamus, cervical spinal cord, thoracic spinal cord, or lumbar spinal cord.

19. An adeno-associated virus (AAV) capsid variant comprising the amino acid sequence of SEQ ID NO: 982.

20. An AAV particle comprising the AAV capsid variant of claim 19.

21. A pharmaceutical composition comprising an AAV particle comprising the AAV capsid variant of claim 19, and a pharmaceutically acceptable excipient.

22. A polynucleotide encoding an adeno-associated virus (AAV) capsid variant comprising an amino acid sequence at least 95% identical to amino acids 203-742 of SEQ ID NO: 982, wherein the amino acid sequence comprises HDSPHK (SEQ ID NO: 2) in variable region IV (VR-IV).

23. The polynucleotide of claim 22, which comprises a nucleotide sequence at least 95% identical to the nucleotide sequence of SEQ ID NO: 984.

24. The polynucleotide of claim 22, which comprises the nucleotide sequence of SEQ ID NO: 984.

25. An adeno-associated virus (AAV) particle comprising an AAV capsid variant comprising an amino acid sequence at least 95% identical to amino acids 203-742 of SEQ ID NO: 982, wherein the amino acid sequence comprises HDSPHK (SEQ ID NO: 2) in variable region IV (VR-IV).

26. The AAV particle of claim 25, which comprises a nucleotide sequence encoding a protein, an antibody, an enzyme, or an inhibitory RNA.

27. The AAV particle of claim 26, further comprising:
(i) a promoter operably linked to the nucleotide sequence;
(ii) a 5' inverted terminal repeat (ITR) and a 3' ITR;
(iii) an enhancer;
(iv) an intron;
(v) an exon;
(vi) a nucleotide sequence encoding at least one microRNA (miR) binding site; and/or
(vii) a polyadenylation (polyA) sequence.

28. The AAV particle of claim 25, wherein the AAV capsid variant comprises the amino acid sequence of amino acids 203-742 of SEQ ID NO: 982.

29. The AAV particle of claim 25, wherein the AAV capsid variant comprises an amino acid sequence at least 95% identical to the amino acid sequence of SEQ ID NO: 982.

30. The AAV particle of claim 25, wherein the AAV capsid variant comprises the amino acid sequence of SEQ ID NO: 982.

* * * * *